(12) United States Patent
Hatzfeld et al.

(10) Patent No.: US 9,683,023 B2
(45) Date of Patent: Jun. 20, 2017

(54) PLANTS HAVING ENHANCED YIELD-RELATED TRAITS AND A METHOD FOR MAKING THE SAME

(75) Inventors: Yves Hatzfeld, Lille (FR); Ana Isabel Sanz Molinero, Madrid (ES); Christophe Reuzeau, Tocan Saint Apre (FR); Valerie Frankard, Waterloo (BE)

(73) Assignee: BASF Plant Science Company GmbH, Ludwigshafen (DE)

( * ) Notice: Subject to any disclaimer, the term of this patent is extended or adjusted under 35 U.S.C. 154(b) by 171 days.

(21) Appl. No.: 13/378,832

(22) PCT Filed: Jun. 10, 2010

(86) PCT No.: PCT/EP2010/058129
§ 371 (c)(1),
(2), (4) Date: Dec. 16, 2011

(87) PCT Pub. No.: WO2011/006717
PCT Pub. Date: Jan. 20, 2011

(65) Prior Publication Data
US 2012/0144532 A1    Jun. 7, 2012

Related U.S. Application Data

(60) Provisional application No. 61/223,431, filed on Jul. 7, 2009, provisional application No. 61/223,429, filed on Jul. 7, 2009, provisional application No. 61/223,389, filed on Jul. 7, 2009, provisional application No. 61/226,307, filed on Jul. 17, 2009, provisional application No. 61/227,448, filed on Jul. 22, 2009, provisional application No. 61/227,803, filed on Jul. 23, 2009.

(30) Foreign Application Priority Data

Jun. 19, 2009 (EP) .................... 09163257
Jun. 19, 2009 (EP) .................... 09163277
Jun. 19, 2009 (EP) .................... 09163287
Jul. 17, 2009 (EP) .................... 09165779
Jul. 22, 2009 (EP) .................... 09166083
Jul. 23, 2009 (EP) .................... 09166200

(51) Int. Cl.
*C12N 15/82* (2006.01)
*C07K 14/415* (2006.01)

(52) U.S. Cl.
CPC ........ *C07K 14/415* (2013.01); *C12N 15/8261* (2013.01); *C12N 15/8273* (2013.01)

(58) Field of Classification Search
None
See application file for complete search history.

(56) References Cited

U.S. PATENT DOCUMENTS

| | | |
|---|---|---|
| 2004/0031072 A1* | 2/2004 | La Rosa et al. ............ 800/278 |
| 2004/0123343 A1 | 6/2004 | La Rosa et al. |
| 2004/0214272 A1 | 10/2004 | La Rosa et al. |
| 2004/0216190 A1 | 10/2004 | Kovalic |
| 2007/0011783 A1 | 1/2007 | Liu et al. |
| 2008/0072340 A1 | 3/2008 | Troukhan et al. |

FOREIGN PATENT DOCUMENTS

| | | |
|---|---|---|
| WO | WO-2004/031349 A2 | 4/2004 |
| WO | WO-2009/003977 A2 | 1/2009 |
| WO | WO-2009/056566 A2 | 5/2009 |

OTHER PUBLICATIONS

Nagano et al, 2001, Nuc. Acid. Res., 29: 4097-4105.*
Forgoux-Nicol et al, 1999, Plant Mol. Bio., 40 :857-872.*
Tuskan et al, 2006, Science, 313:1596-1604.*
de Pater et al, 1994, Plant Journal, 2:837-844.*
Laizet et al., "Subfamily Organization and Phylogenetic Origin of Genes Encoding Plastid Lipid-Associated Proteins of the Fibrillin Type", Journal of Genome Science and Technology, 2004, vol. 3, No. 1, pp. 19-28.
"Transcription factor G3091, SEQ ID 664", Accession No. ADO62197, Jul. 15, 2004.
"Transcription factor G3094, SEQ ID 666", Accession No. ADO62199, Jul. 15, 2004.
"Glycine max protein SEQ ID No. 270777", Accession No. AFQ79600, Oct. 18, 2007.
"Transcription factor G3095, SEQ ID 668", Accession No. ADO62201, Jul. 15, 2004.
International Search Report for PCT/EP2010/058129, mailed Feb. 10, 2011.
International Preliminary Report on Patentability for PCT/EP2010/058128, issued Apr. 3, 2012.
Castle, A., et. al., "Ubiquitously expressed secretory carrier membrane proteins (SCAMPs) 1-4 mark different pathways and exhibit limited constitutive trafficking to and from the cell surface", Journal of Cell Science, vol. 118, (2005), pp. 3769-3780.
Fernández-Chacón, R., et. al., "Novel SCAMPs Lacking NPF Repeats: Ubiquitous and Synaptic Vesicle-Specific Forms Implicate SCAMPs in Multiple Membrane-Trafficking Functions", The Journal of Neuroscience, vol. 20, No. 21, (2000), pp. 7941-7950.

(Continued)

Primary Examiner — Jason Deveau Rosen
(74) Attorney, Agent, or Firm — Drinker Biddle & Reath LLP

(57) ABSTRACT

The present invention relates generally to the field of molecular biology and concerns a method for enhancing yield related traits by modulating expression in a plant of a nucleic acid encoding a eRF1 polypeptide, a SCAMP-like (secretory carrier membrane proteins) polypeptide, a PLATZ (plant AT-rich sequence- and zinc binding protein) polypeptide, a PLST-like polypeptide or a Glomalin (HSP60, chaperonin CNP60) polypeptide. The present invention also concerns plants having modulated expression of a nucleic acid encoding said polypeptides, which plants have enhanced yield-related traits relative to corresponding wild type plants or other control plants. The invention also provides constructs useful in the methods of the invention.

22 Claims, 40 Drawing Sheets

(56) References Cited

OTHER PUBLICATIONS

Gadkar, V., et. al., "The arbuscular mycorrhizal fungal protein glomalin is a putative homolog of heat shock protein 60", FEMS Microbiol Lett, vol. 263, (2006), pp. 93-101.

Lam, S., et. al., "Rice SCAMP1 Defines Clathrin-Coated, trans-Golgi-Located Tubular-Vesicular Structures as an Early Endosome in Tobacco BY-2 Cells", The Plant Cell, vol. 19, (2007), pp. 296-319.

Nagano, Y., et. al., "A novel class of plant-specific zinc-dependent DNA-binding protein that binds to A/T-rich DNA sequences", Nucleic Acids Research, vol. 29, No. 20, (2001), pp. 4097-4105.

Rey, P., et. al., "Over-expression of a pepper plastid lipid-associated protein in tobacco leads to changes in plastid ultrastructure and plant development upon stress", The Plant Journal, vol. 21, No. 5, (2000), pp. 483-494.

Russinova, E., et. al., "Heterodimerization and Endocytosis of Arabidopsis Brassinosteroid Receptors BRI1 and AtSERK3 (BAK1)", The Plant Cell, vol. 16, (2004), pp. 3216-3229.

Salvucci, M., et. al., "Association of Rubisco activase with chaperonin-60$\beta$: a possible mechanism for protecting photosynthesis during heat stress", Journal of Experimental Botany, vol. 59, No. 7, (2008), pp. 1923-1933.

Šamaj, J., et. al., "Endocytosis, Actin Cytoskeleton and Signaling", Plant Physiology, vol. 135, (2004), pp. 1150-1161.

Yang, Y., et. al., "Fibrillin expression is regulated by abscisic acid response regulators and is involved in abscisic acid-mediated photoprotection" PNAS, vol. 103, No. 15, (2006), pp. 6061-6066.

Abe, H. et al., "Arabidopsis AtMYC2 (bHLH) and AtMYB2 (MYB) Function as Transcriptional Activators in Abscisic Acid Signaling", The Plant Cell, 2003, vol. 15, pp. 63-78.

Van Camp, W., "Yield Enhancement Genes: Seeds for Growth", Current Opinion in Biotechnology, 2005, vol. 16, pp. 147-153.

\* cited by examiner

CLUSTAL W (1.81) multiple sequence alignment

```
H.vulgare_TA39331_4513#1                      -----MAGRYDGGNPFEEEEDVNPFSEQARGKAGGQSNYGGGGAFYMPNP
T.aestivum_TA81857_4565#1                     -----MAGRYDGGNPFEEEEDVNPFSEQTRGKAGGQSNYGGGGAFYMPNP
Z.mays_ZM07MC31327_BFb0342A21@                -----MAGRYDGNP--FEEEDVNPFSEQARGKAGGQSNFGGG-AFYMPNT
Z.mays_ZM07MC32029_BFb0293C15@                -----MAGRYDGNP--FEEEDVNPFSQQTRGKAGGQSNFGGG-AFYMPNP
O.sativa_LOC_Os07g37740.1#1                   -----MAGRYDSNP--FEEDDVNPFSEQARGKAGGQPSYGGG-AFYMPNP
O.sativa_LOC_Os05g42330.1#1                   -----MAGKHGRNG--FEDDDVNPFAGGS---------------------
Z.mays_ZM07MC22858_BFb0220H23@                -----MAGKHGRNG--FDDDNVNPFAGGS---------------------
H.vulgare_TA36210_4513#1                      --------MAGRNG--FEDDDVNPFAGGS---------------------
O.sativa_LOC_Os01g57220.1#1                   -----MAGRYDRNP--FDEDDVNPFAGGS---------------------
Z.mays_ZM07MC27067_BFb0182O18@                -----MAGRYDRNP--FEEDDVNPFAGGS---------------------
T.aestivum_TA51636_4565#1                     -----MAGRYDRNP--FDEDDVNPFAGGG---------------------
T.aestivum_CK163668#1                         -----MAGRYDRNP--FDEDDVNPFAGGG---------------------
T.aestivum_TA50955_4565#1                     -----MAGRYDRNP--FDEDDVNPFAGGG---------------------
T.aestivum_TA72069_4565#1                     --------------------------------------------------
A.thaliana_AT2G20840.1#1                      ------MSRYQSHS-FDDG-EINPFAN-----------------------
B.napus_BN06MC09315_42883615@9                ------MSRYESPS-FDDG-EVNPFAN-----------------------
P.trichocarpa_scaff_120.48#1                  ------MSRYDSNP-FEEE-EVNPFADQGGKGKGSGQSNYGG----GAFY
P.trichocarpa_scaff_XIII.1138#                ------MSRYDSNP-FDEE-EVNPFADQGGKGKGSGQSNYGG----GAFY
A.thaliana_AT1G03550.1#1                      -------MARHDPNP-FADE-EINPFAN----------------------
S.lycopersicum_TA43976_4081#1                 -----MAGRYNDNP-FAEEDEVNPFSNNG---------------------
A.thaliana_AT1G61250.1#1                      -----MANRYDPNP-FAEEEEVNPFANAR---------------------
B.napus_BN06MC05708_42365297@5                -----MANRYDPNP-WGVVEEVYCFAKEG---------------------
A.thaliana_AT1G11180.1#1                      -----MGGRYDRNT-FDEQDEVNPFANPG---------------------
M.truncatula_TA20357_3880#1                   -----MAGRYDSNP--FDEEQVNPFSN----------------------S
P.sativum_TA772_3888#1                        -----MAGRYDPNP--FDEEQVNPFSN-----------------------P
G.max_GM06MC34782_sp08b05@3397                -----MAGRYDSNP--FDEEEVNPFSN-----------------------P
M.truncatula_TA21989_3880#1                   -----MAGRYESNP--FDEEEVNPFSEPAAKGKTSSQSNYSGGAFYTTNP
P.trichocarpa_scaff_XI.291#1                  -----MAGRYDPNP--FDEEEVNPFSDPAVRSKASGQSKYGG---RAFNT
S.lycopersicum_TA41016_4081#1                 -----MAGRYDHNP-FEEEEEVNPFADGGGRGKSSGQSKFSG--GAFYTT
O.sativa_LOC_Os03g38590.2#1                   --MAGRSRYDNPFEE-GGGDEVNPFADKASKGGSAGQSSYSG--GAFYTT
O.sativa_LOC_Os03g38590.1#1                   --MAGRSRYDNPFEE-GGGDEVNPFADKASKGGSAGQSSYSG--GAFYTT
H.vulgare_TA44339_4513#1                      --MTARTKYDNPFEETGGGDEVNPFADKATREAPATQSGYSG--GSFYAT
Z.mays_ZM07MC25122_BFb0162C02@                --MAGRSRYDNPFEE-GGADEVNPFADQAKRGGSTAQSGYSG--GAFYTT
Z.mays_ZM07MC20385_BFb0172E11@                --MAGRSRYDNPFEE-GGADEVNPFADQAKRGGSSAQSGYSG--GAFYTT
O.sativa_LOC_Os03g38600.1#1                   MAAGGRWGHSDNPFEEVEIDQVNPFSHPRP--------------------
P.patens_147248#1                             -----MAGRYDRNPFEPEEEEVNPFSVMVRAQATKPSYGGGG--LFNDPE
P.patens_181545#1                             -----MADRYDRNPFDEAEEEVNPFSTSRLMRYFSNSS------------
P.patens_178454#1                             -----MAGRYDSNPFDE-EEQVNPFSERLNAIQDPNSG------------
A.cepa_TA5060_4679#1                          ------MQRDPNPFDEDH---VNPFAKSADS-------------------
M.truncatula_TA32267_3880#1                   ----MNRNHDPNPFEEE---VNPFSN--GT--------------------
A.thaliana_AT1G32050.1#1                      ----MNRHHDPNPFDEDE-EIVNPFSKGGCR-------------------
B.napus_BN06MC16749_45336122@1                ----MNRHHDPNPFDEEEDEIVNPFSKGAG--------------------
P.trichocarpa_scaff_III.723#1                 ---MSRYNSDPNPFDEEE--EVNPFSKGAVA-------------------
P.trichocarpa_scaff_29.268#1                  ---MSRFNSDPNPFDEEE--EVNPFSKGSSV-------------------
H.vulgare_TA38269_4513#1                      -------MHHDPNPFDEGTAGDENPFSNGGG---------RGG-------
T.aestivum_TA75461_4565#1                     ------MHHDPNPFDEGTAGDENPFSNGGG---------RGG--------
T.aestivum_TA75459_4565#1                     ------MHHDPNPFDEGTAGDENPFSNGGG---------RGG--------
Z.mays_ZM07MC20685_BFb0020D20@                ------MHHDPNPFDEGSAED-NPFSNGGA---------GGG--------
O.sativa_LOC_Os04g50890.1#1                   ------MHHDPNPFDEGNADDNPFSNGGGG---------GGGG-------
O.sativa_LOC_Os02g47010.1#1                   ------MHHDPNPFDEG--ADDNPFSNGGGGGARRGGGGGGGG-------
T.aestivum_DR738056#1                         ------MYRDPNPFDEG--ADDNAFSNGGG-----RGGAGGGGG------
O.sativa_LOC_Os08g06440.1#1                   --------------------------MAPGP-------------------
T.aestivum_TA95653_4565#1                     ------MSPSTYPLEDENVNPTANWKLSAPA-------------------
```

FIGURE 3

```
H.vulgare_TA39331_4513#1                   RNVAPSS-NSRLSPLPPEPADFSATV----DIPLESS---KDLKKREKEL
T.aestivum_TA81857_4565#1                  RNVAPSS-NSRLSPLPPEPADFSATV----DIPLESS---KDLKKREKEL
Z.mays_ZM07MC31327_BFb0342A21@             RNMPPAS-NSRLSPLPPEPADFSATV----DIPLDSS---KDLKRREKEL
Z.mays_ZM07MC32029_BFb0293C15@             QNVPPTS-NSRLSPLPPEPADFSATV----DIPLDSS---KDLKRREKEL
O.sativa_LOC_Os07g37740.1#1                RNVPSVSSNSRLSPLPPEPAAFGATV----DIPLDSS---KDLKNREKEL
O.sativa_LOC_Os05g42330.1#1                ---VPPANNSRLPPLSHEPADFYNVD-----IPLDSS---KDLKKKEKEL
Z.mays_ZM07MC22858_BFb0220H23@             ---VPPATNSRLSPLSHEPADFYNVD-----IPLDSS---KDLKKKEKEL
H.vulgare_TA36210_4513#1                   ---VPPASNSRLSPLSHEPAGFYNVD-----IPMDST---KDVKKKEKEL
O.sativa_LOC_Os01g57220.1#1                ---VPPASNSRMPPLPHEPG-FYNDRGATVDIPLDST---KDMKKKEKEL
Z.mays_ZM07MC27067_BFb0182O18@             ---VPPASNSRMSALPHEPAGFYNDRGATVDIPLDST---KDLSKKEKEL
T.aestivum_TA51636_4565#1                  ---VPPASNSRMPPLPHEPAGFYNDRAATVDIPLGSS---KDLQKEKEL
T.aestivum_CK163668#1                      ---VPPASNSRMPPLPHEPAGFYNDR-ATVDIPLGSS---KDLQKEKEL
T.aestivum_TA50955_4565#1                  ---VPPASNSRMPPLPHEPAGFYNDR-ATVDIPLGSS---KDLQKEKEL
T.aestivum_TA72069_4565#1                  --------------------------------------------------
A.thaliana_AT2G20840.1#1                   ---PTSVPAATSKLSPLPPEPYDRGATMDIPLDSG-----KDLKAKEKEL
B.napus_BN06MC09315_42883615@9             ---PSTVPAATSQYD-------RGGATTDIPLDSA----GKDLKAKEKEL
P.trichocarpa_scaff_120.48#1               MPNPGSVPPATSRLSPLPHEPYDRGATIDIPLDSG-----KELKAKEKEL
P.trichocarpa_scaff_XIII.1138#             MPNPGSVPPATSRLSPLPHEPYDRGATIDIPLDSG-----KDIKAKEKEL
A.thaliana_AT1G03550.1#1                   --HTSVPPASNSYLKPLPPEPYDRGATVDIPLDSG-----NDLRAKEMEL
S.lycopersicum_TA43976_4081#1              --SVPAASNSRPYPLPHEPAGYDRGATVDIPLDGS-----NDMKKKEKEL
A.thaliana_AT1G61250.1#1                   --GVPPASNSRLSPLPPEPVGFDYGRTVDIPLDR--AGT-QDLKKKEKEL
B.napus_BN06MC05708_42365297@5             --SVPAASNSRLSPLPPDPVGFDYGRTVDIPLGNDRSGT-QNLKKKEKEL
A.thaliana_AT1G11180.1#1                   --SVPAASNSRLSPLPPEPVGFGYGRTVDIPLDRPGSGA-QDLKKKEKEL
M.truncatula_TA20357_3880#1                GGVAPATNSRPAPLNPERAGYN-YGFGQTVDIPLDAS---TDVKKKEREL
P.sativum_TA772_3888#1                     RSAASATNSRPAPLNPDRADYN-YGFGPTVDIPLDTS---TDGKKKERDL
G.max_GM06MC34782_sp08b05@3397             GSVPAATNSRLPPLKPEPVDYN-YGFGATVDIPLDSS---MDLKKKEKEL
M.truncatula_TA21989_3880#1                GSVPPAKNSRLSPLEPEPADYNNYGFGATVDIPLDTS---TDLKKREKEL
P.trichocarpa_scaff_XI.291#1               ASAPPASNSRLSPLPPEPADFY--NYGNTVDIPIDAP---ADLRKKEKEL
S.lycopersicum_TA41016_4081#1              SGSVPPATNSRLSPLPPEPADFYDRN-ASIDIPLDSAS--DLKKKEKEL
O.sativa_LOC_Os03g38590.2#1                QSRPSAPPATHLSPLPPEPADFYNDFSTPVDIPMDTS---KDMKTREKEL
O.sativa_LOC_Os03g38590.1#1                QSRPSAPPATHLSPLPPEPADFYNDFSTPVDIPMDTS---KDMKTREKEL
H.vulgare_TA44339_4513#1                   QPRPSPSNITRLSPLPPEPADFYNDFASPHTN-------KDMKTMEKEL
Z.mays_ZM07MC25122_BFb0162C02@             QSQRPAPPSTRLSPLPPEPADFYNDFATPVDIPMDTN---KDMKTREKEL
Z.mays_ZM07MC20385_BFb0172E11@             QSQRPAPPSTRLSPLPPEPADFYNDFATPVDIPMDTN---KDMKTREKEL
O.sativa_LOC_Os03g38600.1#1                -----------TPLPHEPVAFYNDPGASVDP-LDSK---KGLKKKEREL
P.patens_147248#1                          PEILLQVSNSRLSPLPHEPAFSGVDDATVDIPLGAGK----DLKKKEKEL
P.patens_181545#1                          --------------------VASLFFFLLKFSMCEQ----DYKKKEKEL
P.patens_178454#1                          ------------LSHLPHEPVFSEVNDATVDIPLGGSK----EMKNKEKEL
A.cepa_TA5060_4679#1                       ------SSKPRFPGLSSLPFGFGFNKNDATDDIPLGSM--NGS---KSSDL
M.truncatula_TA32267_3880#1                ------GSKSRVPSVASEPLGFGQRHDATVDIPLETS---NGDSKKKSQEL
A.thaliana_AT1G32050.1#1                   ------VPAASRPVEYGQS------LDATVDIPLDNM---NDS-SQKQRKL
B.napus_BN06MC16749_45336122@1             ------GAGRPVASRPFN------VDATVDIPLDTV---NDS-SKKQREL
P.trichocarpa_scaff_III.723#1              ------PASKARIPPLGHEAMGFGHNDATVDIPLDTM---NDS-KKKGKDL
P.trichocarpa_scaff_29.268#1               ------PAVKARIPPLGHEPMGFGHNDATVDIPLDTM---NDS-KKKEKDL
H.vulgare_TA38269_4513#1                   --KQQYGFRPTEPVGFGGGGGGSRGDATVDVPLDNM--GDS-NGNAREL
T.aestivum_TA75461_4565#1                  --KQQHGFRPTEPVGFGG---GGSRGDATVDVPLGNM--GDS-NGKAREL
T.aestivum_TA75459_4565#1                  --KKQYGFRPTEPVGFGGG--GGSRGDATVDVPLGNM--GDS-NGKAREL
Z.mays_ZM07MC20685_BFb0020D20@             --KQQYGFRPTEPVGFGG----ASRGDAVVDVPLETM--GDS-RSKVKEL
O.sativa_LOC_Os04g50890.1#1                GSRQQYGFRPTEPAGFGAG-----RGDATVDVPLDTM--GDS-KSKAREL
O.sativa_LOC_Os02g47010.1#1                GGGGGKSQFSFGFGGLGGG----SKGGATVDIPLDNM--SDS-KGKGKEL
T.aestivum_DR738056#1                      GGKSQFQFRPTEPVGFGAG----GNGDAAVDIPLDNM--NGS-NGKESEL
O.sativa_LOC_Os08g06440.1#1                --------EKKKSWMPAGLGGSGKLGATIDIPLEDP--RKK----EKEL
T.aestivum_TA95653_4565#1                  --------PAKKSWIPAGFGGSGKHDATIDIPLYDP--KKR----EQEL
```

FIGURE 3 (continued)

```
H.vulgare_TA39331_4513#1                    QAREAELNKREKELKRREEAAARAG-------------------------
T.aestivum_TA81857_4565#1                   QAREAELNKREKELKRREEAAARAG-------------------------
Z.mays_ZM07MC31327_BFb0342A21@              QAREAELNKREKELKRREEAAARAG-------------------------
Z.mays_ZM07MC32029_BFb0293C15@              QAREAELNKREKELKRREEAAARAG-------------------------
O.sativa_LOC_Os07g37740.1#1                 QAREAELNKREKELKRREEAAARAG-------------------------
O.sativa_LOC_Os05g42330.1#1                 QAMEAELNKRERELKRKEEAAAQAG-------------------------
Z.mays_ZM07MC22858_BFb0220H23@              QAMEAELNKRERELKRKEEAASRAG-------------------------
H.vulgare_TA36210_4513#1                    QAMEAELNKREKELKRKEEAASRAG-------------------------
O.sativa_LOC_Os01g57220.1#1                 QAKEAELNKRESELRRREEAASRAG-------------------------
Z.mays_ZM07MC27067_BFb0182O18@              QAKEAELNKRERELKRKEEAAARAG-------------------------
T.aestivum_TA51636_4565#1                   QSKEAELNKRERELKRREEAAARAG-------------------------
T.aestivum_CK163668#1                       QSKEAELNKRERELKRREEAAARAG-------------------------
T.aestivum_TA50955_4565#1                   QSKEAELNKRERELKRREEAAARAG-------------------------
T.aestivum_TA72069_4565#1                   ------------------MVIAG---------------------------
A.thaliana_AT2G20840.1#1                    REKEAELKRREQEIKRKEDAIAQAG-------------------------
B.napus_BN06MC09315_42883615@9              QAKESELKRREQELKRKEDAIAQAG-------------------------
P.trichocarpa_scaff_120.48#1                QAKEAELRRREQELKRKEDAIARAG-------------------------
P.trichocarpa_scaff_XIII.1138#              QAKEAELKRREQELKRKEEDAIARAG-------------------------
A.thaliana_AT1G03550.1#1                    QAKENELKRREQELKRREDAIARTG-------------------------
S.lycopersicum_TA43976_4081#1               QAKEAELKKREQELKRKEDAITRAG-------------------------
A.thaliana_AT1G61250.1#1                    QAKEAELKRREQDLKRKEDAAARAG-------------------------
B.napus_BN06MC05708_42365297@5              QAKEADLRRREQEVKRREDAAARAG-------------------------
A.thaliana_AT1G11180.1#1                    QAKEADLRRREQDLKRKQDAAARAG-------------------------
M.truncatula_TA20357_3880#1                 QAKEAELRKREQEVRRKEEAISRAG-------------------------
P.sativum_TA772_3888#1                      QAKEAELRKREQEVRRKEEAIARAG-------------------------
G.max_GM06MC34782_sp08b05@3397              QAKETELRKREQEVRRKEEAASRAG-------------------------
M.truncatula_TA21989_3880#1                 QSKEADLRRREQEVRRKEEAAARAG-------------------------
P.trichocarpa_scaff_XI.291#1                QAKEAELRRREQEVKRREDAAARAG-------------------------
S.lycopersicum_TA41016_4081#1               QSKENELRRREQDLKRREDAAARAG-------------------------
O.sativa_LOC_Os03g38590.2#1                 LAKEAELNRREKEIKRREEAAARAG-------------------------
O.sativa_LOC_Os03g38590.1#1                 LAKEAELNRREKEIKRREEAAARAG-------------------------
H.vulgare_TA44339_4513#1                    LAKEAELSRREKEIRRREEAAARAG-------------------------
Z.mays_ZM07MC25122_BFb0162C02@              LAKEAELNRREKEIKRREDAAARAG-------------------------
Z.mays_ZM07MC20385_BFb0172E11@              LAKEAELNRREKEIKRREEDAAARAG-------------------------
O.sativa_LOC_Os03g38600.1#1                 LAKEAELNKREQELKRREEALARAG-------------------------
P.patens_147248#1                           KAREEELRRREQDLKRREEAAERAG-------------------------
P.patens_181545#1                           KAKEEELRRKEQELKRREDAVARAG-------------------------
P.patens_178454#1                           KAKEEELKRREKELKRREDAASIAG-------------------------
A.cepa_TA5060_4679#1                        ASWEADLRRREQEIRRREEALSNAG-------------------------
M.truncatula_TA32267_3880#1                 AVWEADLKRREKDIKRREDSVAKAG-------------------------
A.thaliana_AT1G32050.1#1                    ADWEAELRKKEMDIKRREEAIAKFG-------------------------
B.napus_BN06MC16749_45336122@1              SDWESELKKRETDIKRREDAVAKSG-------------------------
P.trichocarpa_scaff_III.723#1               ASWEADLKRREKEIKRREDAVAKSKDYNLQIFLLLKSYIYGFVECLLLTQ
P.trichocarpa_scaff_29.268#1                ASWEADLKRREKEIKRREDAVAKTG-------------------------
H.vulgare_TA38269_4513#1                    SSWESDLRRREADIKRREESLKNAG-------------------------
T.aestivum_TA75461_4565#1                   SSWESDLRRREADIKRREESLKNAG-------------------------
T.aestivum_TA75459_4565#1                   SSWESDLRRREADIKRREESLKNAG-------------------------
Z.mays_ZM07MC20685_BFb0020D20@              SSWESDLKRREADIKRREEALKNAG-------------------------
O.sativa_LOC_Os04g50890.1#1                 SSWETDLKRREADIKRREEALRNAG-------------------------
O.sativa_LOC_Os02g47010.1#1                 LQWEADLKRREADIRRREEALKSAG-------------------------
T.aestivum_DR738056#1                       SQWQADLKRREADIKRREEALKSAG-------------------------
O.sativa_LOC_Os08g06440.1#1                 LAWEEDLRRREIDIKQRFNAMDRAG-------------------------
T.aestivum_TA95653_4565#1                   LSWEEDLKRRERDIIQRENAMNRAG-------------------------
```

FIGURE 3 (continued)

| | |
|---|---|
| H.vulgare_TA39331_4513#1 | ---------------IVIEEKNWPPFMPLIHHDIANEIPTHLQRMQYFAFASF |
| T.aestivum_TA81857_4565#1 | ---------------IVIEEKNWPPFLPLIHHDIANEIPTHLQRMQYFAFASF |
| Z.mays_ZM07MC31327_BFb0342A21@ | ---------------TVIEEKNWPPFLPLIHHDITNEIPSHLQRMQYVAFASF |
| Z.mays_ZM07MC32029_BFb0293C15@ | ---------------IVIEEKNWPPFMPLIHHDIINEIPSHLQRMQYVAFASF |
| O.sativa_LOC_Os07g37740.1#1 | ---------------IVIEEKNWPPFLPLIHHDITNEIPSHLQRMQYVAFASF |
| O.sativa_LOC_Os05g42330.1#1 | ---------------IVIEDKNWPPFFPLIHHNISNEIPIHLQRMQYLAFSSF |
| Z.mays_ZM07MC22858_BFb0220H23@ | ---------------VVIEEKNWPPFFPLIHHDISNEIPIHLQRMQYLAFSSF |
| H.vulgare_TA36210_4513#1 | ---------------IVIEDKNWPPFFPLTHHNISNEIPIHLQKMQYLAFSSF |
| O.sativa_LOC_Os01g57220.1#1 | ---------------IVIEDKNWPPFFPIIHHDISNEIPIHLQRMQYLAFSSL |
| Z.mays_ZM07MC27067_BFb0182O18@ | ---------------IVIEDKNWPPFMPIIHHDISNEIPIHLQRMQYLAFSSL |
| T.aestivum_TA51636_4565#1 | ---------------IVIETKNWPPFMPIIHHDISNEIPIHLQRMQYLAFCSL |
| T.aestivum_CK163668#1 | ---------------IVIETKNWPPFMPIIHHDISNEIPIHLQRMQYLAFCSL |
| T.aestivum_TA50955_4565#1 | ---------------IVIETKNWPPFMPIIHHDISNEIPIHLQRMQYLAFCSL |
| T.aestivum_TA72069_4565#1 | ---------------IVIEDKNWPPFFPLIHHNISNEIPIHLQKMQYLAFSSF |
| A.thaliana_AT2G20840.1#1 | ---------------IVIEEKNWPPFFPLIHHDISNEIPIHLQRIQYVAFTSM |
| B.napus_BN06MC09315_42883615@9 | ---------------IVIEDKNWPPFFPLIHHDISNEIPIHLQRIQYVAFTSL |
| P.trichocarpa_scaff_120.48#1 | ---------------IVIEDKNWPPFFPIIHHDIGNEIPIHLQKIQYVAFTTF |
| P.trichocarpa_scaff_XIII.1138# | ---------------IVIEDKNWPPFFPIIHHDIGNEIPIHLQKMQYVAFTTL |
| A.thaliana_AT1G03550.1#1 | ---------------VVIEEKNWPEFFPLIHHDIPNEIPIHLQKIQYVAFTTL |
| S.lycopersicum_TA43976_4081#1 | ---------------VVIEDKNWPPFFPIIHHDIANEIPIHLQKLQYVAFTTL |
| A.thaliana_AT1G61250.1#1 | ---------------IVIEVKNWPPFFPLIHHDIANEIPVHLQRLQYVTFATY |
| B.napus_BN06MC05708_42365297@5 | ---------------ITTEVKNWPPFFPLIHHDIANEIPVHLQRLQYVTFATY |
| A.thaliana_AT1G11180.1#1 | ---------------IVIEAKNWPTFFPLIHHDIANEILVRLQRLQYIAFATY |
| M.truncatula_TA20357_3880#1 | ---------------IVIEEKNWPPFFPIIHHDIANEIPVHLQRLQYVAFFSL |
| P.sativum_TA772_3888#1 | ---------------IVIEEKNWPPFFPIIHHDITNEIPIHLRTLQYVAFFSL |
| G.max_GM06MC34782_sp08b05@3397 | ---------------IVLEEKNWPPFFPIIHHDIANEIPIHLQKLQYVAFTTL |
| M.truncatula_TA21989_3880#1 | ---------------IVIEEKNWPPFFPIIHHDIANEIPVHLQKLQYVAFTTY |
| P.trichocarpa_scaff_XI.291#1 | ---------------IVLEEKNWPPFFPIIHHDIANEIPVHLQKIQYVAFTTF |
| S.lycopersicum_TA41016_4081#1 | ---------------IVLEEKNWPPFFPIIHHDIANEIPIHLQKLQYVAFTTF |
| O.sativa_LOC_Os03g38590.2#1 | ---------------IVLEDKNWPPFFPIIHNDIGNEIPVHLQRTQYVAFASL |
| O.sativa_LOC_Os03g38590.1#1 | ---------------IVLEDKNWPPFFPIIHNDIGNEIPVHLQRTQYVAFASL |
| H.vulgare_TA44339_4513#1 | ---------------VVIEEKNWPPFFPIIHHDINNEIPVHLQRTQYVAFASL |
| Z.mays_ZM07MC25122_BFb0162C02@ | ---------------IVLEEKNWPPFFPIIHNDIGNEIPVHLQRTLYVAFASL |
| Z.mays_ZM07MC20385_BFb0172E11@ | ---------------VVLEEKNWPPFFPIIHNDIGNEIPVHLQRTLYVAFASL |
| O.sativa_LOC_Os03g38600.1#1 | ---------------VFIEPKNWPPFFPVIHVDISNDIPVHLQRVQYVAFASL |
| P.patens_147248#1 | ---------------IRIEEKNWPPFINILHHDIANDIPAHSRGLQRWAYASW |
| P.patens_181545#1 | ---------------VSIESRNWPPFIHILHEDIANDIPAHSRGLMRWAYASW |
| P.patens_178454#1 | ---------------IVIESRNWPPLVPILHHDIANDIPEHVRGLMYRAYASW |
| A.cepa_TA5060_4679#1 | ---------------VPVEEKNWPPFFPIIHHDISKEIPIHAQRLQYLAFASW |
| M.truncatula_TA32267_3880#1 | ---------------VPVDDKNWPPFFPIIHEDIANEIPVHAQRLQYSAFASW |
| A.thaliana_AT1G32050.1#1 | ---------------VQTDDKNWPPFFPIIHHDIAKEIPVHAQKLQYLAFASW |
| B.napus_BN06MC16749_45336122@1 | ---------------VKTSDKNWPPFFPIIHHDIANEIPVHAQKLQYLAFASW |
| P.trichocarpa_scaff_III.723#1 | FFFSILHGISAGITPNDKNWPPFFPIIHHDIANEIPIHAQRIQYLAFASW |
| P.trichocarpa_scaff_29.268#1 | ---------------ITPDDKNWPPFFPIIHHDIANEIPIHAQRLQYLAFASW |
| H.vulgare_TA38269_4513#1 | ---------------VPMEEKNWPPFFPIIHHDIANEIPANVQKLQYLAFASW |
| T.aestivum_TA75461_4565#1 | ---------------VPMEEKNWPPFFPIIHHDIANEIPANVQKLQYLAFASW |
| T.aestivum_TA75459_4565#1 | ---------------VPMEDKNWPPFFPIIHHDIANEIPANVQKLQYLAFASW |
| Z.mays_ZM07MC20685_BFb0020D20@ | ---------------VPMEEKNWPPFFPIIHHDIANEIPANVQKLQYLAFASW |
| O.sativa_LOC_Os04g50890.1#1 | ---------------VPMEDKNWPPFFPIIHHDIANEIPANLQKLQYLAFASW |
| O.sativa_LOC_Os02g47010.1#1 | ---------------VPMEEKNWPPFFPIIHHDIANEIPANAQKLQYLAFASW |
| T.aestivum_DR738056#1 | ---------------VPMEDKNWPPFFPIIHHDIANEIPANAQRLQYLAFASW |
| O.sativa_LOC_Os08g06440.1#1 | ---------------VTVEVKNWPPFYPIIHHDIASEIPTHAQKLQYMAFGSW |
| T.aestivum_TA95653_4565#1 | ---------------VTIEVKNWPPFFPVIHHDIANEIPTHAHQLQYSAFASW |
| | :   .:***  :   ::* :* .:*   . :      ::  : |

FIGURE 3 (continued)

```
H.vulgare_TA39331_4513#1                    LGLVCCLFWNVVAVTTAWIKGE-GVKIWLLAIIYFISGVPGAYVLWYRPL
T.aestivum_TA81857_4565#1                   LGLVCCLFWNVVAVTSAWIKGE-GVKIWLLAIIYFISGVPGAYVLWYRPL
Z.mays_ZM07MC31327_BFb0342A21@              LGLVCCLFWNVIAVTTAWIKGE-GVKIWLLAIIYFISGVPGAYVLWYRPL
Z.mays_ZM07MC32029_BFb0293C15@              LGLVCCLFWNVIAVTTAWIKGE-GVKIWLLAIIYFISGVPGAYVLWYRPL
O.sativa_LOC_Os07g37740.1#1                 LGLACCLFWNVIAVTSAWVKGE-GVKIWLLAIIYFISGVPGAYVLWYRPL
O.sativa_LOC_Os05g42330.1#1                 LGLAACLFWNIIATTTAWVKGE-GVIIWLLAIIYFISGVPGAYVLWYRPL
Z.mays_ZM07MC22858_BFb0220H23@              LGLIACLFWNIIATTTAWIKGE-GVMIWLLAIIYFISGAPGAYVLWYRPL
H.vulgare_TA36210_4513#1                    LGIALCLFFNIIATTTAWIKGE-GVMVWLLAIIYFISGVPGAYVLWYRPL
O.sativa_LOC_Os01g57220.1#1                 LGLAACLFWNIIATTAAWIKGA-GVMIWLLAIIYFISGVPGAYVLWYRPL
Z.mays_ZM07MC27067_BFb0182O18@              LGLTACLFWNIIATTAAWIKSE-GVMIWLLAIIYFISGVPGAYVLWYRPL
T.aestivum_TA51636_4565#1                   LGLTLCLFWNIIATTAAWIKGA-GVVIWLLAIIYFISGVPGAYVLWYRPL
T.aestivum_CK163668#1                       LGLTLCLFWNIIATTAAWIKGA-GVVIWLLAIIYFISGVPGAYVLWYRPL
T.aestivum_TA50955_4565#1                   LGLTLCLFWNIIATTAAWIKGA-GVVIWLLAIIYFISGVPGAYVLWYRPL
T.aestivum_TA72069_4565#1                   LGIALCLFFNIIATTTAWIKGE-GVMVWLLAIIYFISGVPGAYVLWYRPL
A.thaliana_AT2G20840.1#1                    LGLVVCLLWNIVAVTTAWIKGE-GPTIWFLAIIYFISGVPGAYVMWYRPL
B.napus_BN06MC09315_42883615@9              LGLVVCLLWNIVAVTTAWIKGE-GPTIWFLAIIYFISGVPGAYVMWYRPL
P.trichocarpa_scaff_120.48#1                LGLFVCLSWNIVAVTTAWIKGE-GPTIWFLAIIYFISGVPGGYVMWYRPL
P.trichocarpa_scaff_XIII.1138#              LGLFVCLSWNIIAVTTAWIKGE-GPTIWFLAIIYFIAGVPGGYVMWYRPL
A.thaliana_AT1G03550.1#1                    LGLVGCLLWNIVAVTVAWIKGE-GPTIWLLSIIYFLAGVPGAYVLWYRPL
S.lycopersicum_TA43976_4081#1               LGLAACLVWNLVAVTLAWIRGE-GPTIWLLAVIYLISGVPGAYVLWYRPL
A.thaliana_AT1G61250.1#1                    LGLVLCLFWNIIAVTTAWIKGE-GVTIWLLALIYFIAGVPGGYVLWYRPL
B.napus_BN06MC05708_42365297@5              LGLVLCLFWNIIAITTAWIKGE-GVTIWLLALIYFIAGVPGGYVLWYRPL
A.thaliana_AT1G11180.1#1                    LGLVLALFWNIIAVTTAWIKGE-GVTIWLLAVIYFISGVPGGYVLWYRPL
M.truncatula_TA20357_3880#1                 LGLVLCLTWNVVAVTAAWIKGE-GVKIWFLAIIYFIAGVPGAYVLWYKPL
P.sativum_TA772_3888#1                      LGLVLCLTWNVVSVTAAWIKGE-GVKIWFLAIIYFIAGVPGAYALWYRPL
G.max_GM06MC34782_sp08b05@3397              LGLVLCLFWNVIAVTAAWIKGE-GVKIWFLAIIYFIAGVPGAYVLWYRPL
M.truncatula_TA21989_3880#1                 LGLVACLLWNVIAVTAAWIKGE-GVKIWFLAIIYFISGVPGAYVLWYRPL
P.trichocarpa_scaff_XI.291#1                LGMAFCLFWNVISVTTLWIKGG-GVNIWFLSVIYFIAGVPGAYVLWYRPL
S.lycopersicum_TA41016_4081#1               LGLIACLLWNIVATTTAWIKEG-DVKIWFLSIIYFISGVPGAYFMWYRPL
O.sativa_LOC_Os03g38590.2#1                 LGLVLCLFWNIICVTAAWIKGE-GPKIWFLAVIYFILGCPGAYYLWYRPL
O.sativa_LOC_Os03g38590.1#1                 LGLVLCLFWNIICVTAAWIKGE-GPKIWFLAVIYFILGCPGAYYLWYRPL
H.vulgare_TA44339_4513#1                    LGLVVCLFLEHRLCYCRLD-------------------------------
Z.mays_ZM07MC25122_BFb0162C02@              LGLVLCLFWNITCTTAAWAKGS-GPKIWFLAIIYFILGCPGAYYLWYRPL
Z.mays_ZM07MC20385_BFb0172E11@              LGLVLCLFWNIICVTAAWAKGS-GPKIWFLAIIYFILGCPGAYYLWYRPL
O.sativa_LOC_Os03g38600.1#1                 LGLVICLFWNIICVSAIAIMWG-DPRAWFLAAIYFITGCPGAYFSWYRPL
P.patens_147248#1                           LGILLCLFWNFICVTAAWIGGVGGVSIFLLGIVYMLSGYVLSYFLWYKPL
P.patens_181545#1                           LGILLCLFWNFVCVLSALIANVGGVQILLLGIIYVLAGYPMSYFLWYKPL
P.patens_178454#1                           LGILLCLLWNFICVTAAWIAGASGVETLPLGFIYMLAGFPMSYFLWNYKPL
A.cepa_TA5060_4679#1                        LGILICLVWNVIAITVCWKKGW-RLLRIFLLACIYAITWDVHCHMCFGTG
M.truncatula_TA32267_3880#1                 LGIVLCLVFNVVAVIVCLDQRR-GC-------------------------
A.thaliana_AT1G32050.1#1                    LGIVLCLVFNVIATMVCWIKGG-GVKIFFLATIYALIGCPLSYVLWYRPL
B.napus_BN06MC16749_45336122@1              LGIVLCLVFNVIAVIVCWIKGG-GVKIFFLATIYALLGCPISYLLWYRPL
P.trichocarpa_scaff_III.723#1               LGIVLCLVFNVIAVTVCWIRGG-GVKIFFLAIIYALMGCPLSYVLWT---
P.trichocarpa_scaff_29.268#1                LGIVLCLVFNLIAVTVCWIRGG-GVKIFFLAVIYVLMGCPLSYILWYRPL
H.vulgare_TA38269_4513#1                    LGIVLCLSWNFIAVIVCWIKEG-DSKLFFLATIYALLGIPLSYLMWYRPL
T.aestivum_TA75461_4565#1                   LGIVLCLSWNFIAVIVCWIKEG-DSKLFFLATIYALLGIPLSYLMWYRPL
T.aestivum_TA75459_4565#1                   LGIVLCLSWNFIAVIVCWIKEG-DSKLFFLATIYALLGIPLSYLMWYRPL
Z.mays_ZM07MC20685_BFb0020D20@              LGIVLCLSWNFVAVIVCWIKEG-DSKLFFLATIYALLGIPLSYLIWYRPL
O.sativa_LOC_Os04g50890.1#1                 LGIVLCLSWNFIAVIVCWIKEG-DSKLFFLATIYALLGIPLSYLIWYRPL
O.sativa_LOC_Os02g47010.1#1                 LGIVLCLFWNFIAVIVCWIRGG-DSKLFFLATIYGMLGMPLSYLMWYRPL
T.aestivum_DR738056#1                       LGIVLCLVWNIIAVTVCWIRGG-DSKLFFLATIYGMLGVPLSYLMWYRPL
O.sativa_LOC_Os08g06440.1#1                 LDVVLFLFAIIYAIFGCP--------------------LSYILWYRPL
T.aestivum_TA95653_4565#1                   LGIVVCLSWNVFAVL-----------------------------------
                                            *.:    *
```

FIGURE 3 (continued)

| | |
|---|---|
| H.vulgare_TA39331_4513#1 | YNAMR------TDSALKFGLFFLLYLFHIVFVVFAAVAPPAVFEGKSLAG |
| T.aestivum_TA81857_4565#1 | YNAMR------TDSALKFGLFFLLYLFHIVFVVFAAVAPPAVFEGKSLAG |
| Z.mays_ZM07MC31327_BFb0342A21@ | YNAMR------TDSALKFGLFFLLYVFHILFCVFSAVAPPVVFEGKSLAG |
| Z.mays_ZM07MC32029_BFb0293C15@ | YNAMR------TDSALKFGLFFLLYLFHILFCVFAAVAPPPAVFEGKSLAG |
| O.sativa_LOC_Os07g37740.1#1 | YNAMR------TDSALKFGLFFLVYLFHILFCVFSAVAPPVVFEGKSLAG |
| O.sativa_LOC_Os05g42330.1#1 | YNAMR------TESALKFGWFFLFYLIHIIFCVWAAVAPPFPFKGKSLAG |
| Z.mays_ZM07MC22858_BFb0220H23@ | YNAMR------TESALKFGWFFLFYMIHIIFCVWAAVAPPFPFKGKSLAG |
| H.vulgare_TA36210_4513#1 | YNAMR------TESALKFGWFFLFYMIHIIFCVWSAVSPPFPFKGNSLTG |
| O.sativa_LOC_Os01g57220.1#1 | YNAMR------TESALKFGWFFLFYLIHILFCIWSAVAPPFPFKGKSLAG |
| Z.mays_ZM07MC27067_BFb0182O18@ | YNAMR------TESALKFGWFFLFYLLHILFCVWSAVAPPFPFKGKSLAG |
| T.aestivum_TA51636_4565#1 | YNAMR------TESALKFGWFFLLYLVTTLPSNPYNILHLVSCVSPISFQ |
| T.aestivum_CK163668#1 | YNAMR------TESALKFGWFFCCT------------------------- |
| T.aestivum_TA50955_4565#1 | YNAMR------TESALKFGWFFLLYLIHIIFCIWSAVSPPFPFKGKSIAG |
| T.aestivum_TA72069_4565#1 | YNAMR------TESALKFGWFFLFYMIHIIFCVWSAVSPPFPFKGNSLTG |
| A.thaliana_AT2G20840.1#1 | YRAMR------TDSALKFGWFFFTYLFHIAFCVFAAVAPPIIFKGKSLTG |
| B.napus_BN06MC09315_42883615@9 | YRAMR------TDSALKFGWFFFTYLFHIGFCVFAAEAPPIIFKGKSLTG |
| P.trichocarpa_scaff_120.48#1 | YRAMR------TDSALKFGWFLLAYLLHIGFCIFAAVAPPIVFKGKSLAG |
| P.trichocarpa_scaff_XIII.1138# | YRAMR------TDSALKFGWFFLFYLFHIGFCIFAAVAPPIVFKGKSLAG |
| A.thaliana_AT1G03550.1#1 | YRATR------TDSALKFGAFFFFYVFHIAFCGFAAVAPPVIFQGKSLTG |
| S.lycopersicum_TA43976_4081#1 | YRAMR------TDSALKFGWFFLSYVFHIGFCIIAAVAPPIFFKGKSLTG |
| A.thaliana_AT1G61250.1#1 | YRAFR------TDSALSFGWFFLFYMLHIAFCVFAAVAPPVVFKGKSLAG |
| B.napus_BN06MC05708_42365297@5 | YRAFR------TDSALSFGWFFLFYMLHILPTVFAAVAPPVVFKGKSLAG |
| A.thaliana_AT1G11180.1#1 | YRAFR------SDSAFNFGWFFLFYMLHILFCLFAAVAPPIVFKGKSLAG |
| M.truncatula_TA20357_3880#1 | YRAFR------TDSAIKFGWFFLFYLLHLGFCILAAVAPPIVFKGKSLTG |
| P.sativum_TA772_3888#1 | YRAFR------TDSAIKFGWFFMFYLLHIGFCILAAVAPPIVFKGKSLTG |
| G.max_GM06MC34782_sp08b05@3397 | YRAFR------NESALKFGWFFLFYLLHIGFCILAAVAPPIVFKGKSLTG |
| M.truncatula_TA21989_3880#1 | YRVFR------TESALKFGWFFMLYLVHIGFCILAAVAPPIVFKGKSLTG |
| P.trichocarpa_scaff_XI.291#1 | YRAFR------TESAMRFGWFFMFYALHIGFCIFAAVAPPIVFKGKSLTG |
| S.lycopersicum_TA41016_4081#1 | YRAFR------TEGAKKFAWFFLVLLGSHCILRLCCCCSSSSLQRKIPYR |
| O.sativa_LOC_Os03g38590.2#1 | YRAMR------NESALKFGWFFLFYLVHIAFCVYAAVSPSILFVGKSLTG |
| O.sativa_LOC_Os03g38590.1#1 | YRAMR------NESALKFGWFFLFYLVHIAFCVYAAVSPSILFVGKSLTG |
| H.vulgare_TA44339_4513#1 | ---------------------------------------------- |
| Z.mays_ZM07MC25122_BFb0162C02@ | YRAMR------NESALKFGWFFLFYLIHIAFCAYAAVSPSILFVGKSLTG |
| Z.mays_ZM07MC20385_BFb0172E11@ | YRAMR------NESALKFGWFFLFYLVHIAFCAYAAVSPSILFVGKSLTG |
| O.sativa_LOC_Os03g38600.1#1 | YRAMR------KESAFRYGWFFLFYFFHISFCIYAAISPSIFFVGRSLTG |
| P.patens_147248#1 | YRAMR------SDSVLRFGWFVMFYLIHTAFCVYAAVAPPFIFKGKSLAG |
| P.patens_181545#1 | YRAMR------SDSVLRFGWFLIFYLLHIAFCVLAAVAPPIIFKGKSLAG |
| P.patens_178454#1 | YRAMR------TESVLKFGWFLVFYLLHISFCVLAAVAPPIIFKGKSLAG |
| A.cepa_TA5060_4679#1 | LCIVQ-------------------------------------------- |
| M.truncatula_TA32267_3880#1 | ---------------------------------------------- |
| A.thaliana_AT1G32050.1#1 | YRAMR------TDSALKFGWFFFTYLIHIGFCIVAAIAPPIFFHGKSLTG |
| B.napus_BN06MC16749_45336122@1 | YRAMR------TDSALKFGWFFFFYLIHIGFCIFAAIAPPIIFRGQSFTG |
| P.trichocarpa_scaff_III.723#1 | ----------DSALKFSWFFVFYLIHIGFCIFAAIAPPIVFHGKSLTG |
| P.trichocarpa_scaff_29.268#1 | YRAMRQALAELTDSALKFGWFFLFYLIHIGFCIFAAIAPPIVFHGKSLTG |
| H.vulgare_TA38269_4513#1 | YRAMR------TNSAFSFGWFFLCYLIHIGFCIIAAIAPPIVFQGKSLTG |
| T.aestivum_TA75461_4565#1 | YRAMR------TNSAFSFGWFFLCYLIHIGFCIIAAIAPPIVFQGKSLTG |
| T.aestivum_TA75459_4565#1 | YRAMR------TNSAFSFGWFFLCYLIHIGFCIIAAIAPPIVFQGKSLTG |
| Z.mays_ZM07MC20685_BFb0020D20@ | YRAMR------TNSAFSFGWFFLCYLIHIGFCIIAAIAPPIVFHGKSLTG |
| O.sativa_LOC_Os04g50890.1#1 | YRAMR------TNSAFSFGWFFLCYLIHIGFCIIAAIAPPIVFHGKSLTG |
| O.sativa_LOC_Os02g47010.1#1 | YRAMR------TDSAFSFGWFFLCYMLHIAFCVFAAIAPPVIFRGKSLTG |
| T.aestivum_DR738056#1 | YRAMR------TDSAFSFGWIILCYMLHIGFCIIAAIAPPIVFRGRSFTG |
| O.sativa_LOC_Os08g06440.1#1 | YSAMR------TDSMVTFVQFFVFYSIHVGFCVIAAVTPPIIFKGKTLTG |
| T.aestivum_TA95653_4565#1 | ---------------------------------------------- |

FIGURE 3 (continued)

| | |
|---|---|
| H.vulgare_TA39331_4513#1 | ILPAIDLISMNALVGIFYFIGFGLFALESLLSIWVIQQVYMYFRGSGKAA |
| T.aestivum_TA81857_4565#1 | ILPAIDLISVNALVGIFYFIGFGLFALESLLSIWVIQQVYMYFRGSGKAA |
| Z.mays_ZM07MC31327_BFb0342A21@ | ILPAIDLISVNALVGIFYFVGFGLFCLESLLSIWVIQQVYMYFRGSGKAA |
| Z.mays_ZM07MC32029_BFb0293C15@ | ILPAIDLISVNALVGIFYFVGFGLFCLESLLSIWVIQQVYMYFRGSGKAA |
| O.sativa_LOC_Os07g37740.1#1 | ILPAIDLISKNALVGIFYFVGFGLFCVESLLSIWVIQQVYMYFRGSGKAA |
| O.sativa_LOC_Os05g42330.1#1 | ILPAIDVIGRSAIVGIFYFVGFGLFCLESLLSIGVIQQVYMYFRGSGKAA |
| Z.mays_ZM07MC22858_BFb0220H23@ | ILPAIDVISKNAIVGIFYFVGFGLFCLESLLSIGVIQQVYMYFRGSGKAA |
| H.vulgare_TA36210_4513#1 | ILPAI--------------------------------------------- |
| O.sativa_LOC_Os01g57220.1#1 | ILPAIDVIGNNAIVGIFYFIGFGLFCLESLLSVVVIQQVYMYFRGSGKAA |
| Z.mays_ZM07MC27067_BFb0182O18@ | ILPAIDIIGRSAIVGIFYFIGFGMFCLESLLSIVVIQQVYMYFRGSGKAA |
| T.aestivum_TA51636_4565#1 | RKIYRWVFAGN--------------------------------------- |
| T.aestivum_CK163668#1 | --------------------------------------------------- |
| T.aestivum_TA50955_4565#1 | FLPAIDVIGSNVIVGIFYFVGFGLFCLEALLSIVVIQQVYMYFRGSGKAA |
| T.aestivum_TA72069_4565#1 | ILPAIDVITKSLIVGIFYFVGFGLFCLESLLSIGVIQQVYMYFRGSGKSQ |
| A.thaliana_AT2G20840.1#1 | ILPAIDVLSGNILVGIFYFIGFGFFCLESLVSIWVIQQVYMYFRGSGKAA |
| B.napus_BN06MC09315_42883615@9 | ILPAIDVLSGNILVGIFYFIGFGFFCLESLVSIWVIQQVYMYFRGSGKAA |
| P.trichocarpa_scaff_120.48#1 | ILPAIDLMGSHALVGIFYFIGFGFFCVESLLSVWVIQQVYMYFRGSGKAA |
| P.trichocarpa_scaff_XIII.1138# | ILPAIDLMGNHALVGIFYFIGFGFFCVESLLSIWVIQQVYMYFRGSGKAA |
| A.thaliana_AT1G03550.1#1 | FLPAIELLTTNAAVGIMYFIGAGFFCIETLLNIWVIQQVYAYFRGSGKAA |
| S.lycopersicum_TA43976_4081#1 | ILPAIDLLGWHALVGIFYFIGAGFFCLETLMSIWVIQQVYMYFRGSGKAA |
| A.thaliana_AT1G61250.1#1 | ILPAIDVLSGQAIVGIFYFICFAFFCLESVVSIWVIQQVYMYFRGSGKQD |
| B.napus_BN06MC05708_42365297@5 | ILPAIDVISGNTLVGIFYFIGFGFFCLESVSIWVIQQVYMYFRGSGKQD |
| A.thaliana_AT1G11180.1#1 | ILPAIDVLSAQALVGIFYFIGFGLFCLESVVSIWVIQQVYMYFRGSGKAD |
| M.truncatula_TA20357_3880#1 | ILSAIDVIGDYTIIGIFYFIGFGLFCL----------------------- |
| P.sativum_TA772_3888#1 | ILSAIDVVGDYTLVGIFYFIGFGFFCLETLISIWVIQQVYMHFRGGGKTA |
| G.max_GM06MC34782_sp08b05@3397 | ILAAIDVLGDHALIGIFYFIGFGLFCIETLISIWVIQQVYMYLRCSGNAA |
| M.truncatula_TA21989_3880#1 | ILSAIDVIDNSTLIGIFYFIGFGFFCLETLISIWVIQQVYMYFRGSGKAA |
| P.trichocarpa_scaff_XI.291#1 | ILAAVDVVGKHALAGIFYFIGFGLFCLESLLSIWVIQQVGMYFRGSGKAA |
| S.lycopersicum_TA41016_4081#1 | HPACGGSHRQKCTCWDFLLHRFWVILSRVIAEHLGYSASIHVFPRKW--- |
| O.sativa_LOC_Os03g38590.2#1 | IFPAISLIGNTVIVGVFYFLGFAMFCLESLLSIVCIFTSGAAGKRPR--- |
| O.sativa_LOC_Os03g38590.1#1 | IFPAISLIGNTVIVGVFYFLGFAMFCLESLLSMWVIQRVYLYFRGSGKEA |
| H.vulgare_TA44339_4513#1 | --------------------------------------------------- |
| Z.mays_ZM07MC25122_BFb0162C02@ | ILPAISLIGDSVIVGIFYFIGFALFCLEALLSVWVIQRVYLYFRGSGKEA |
| Z.mays_ZM07MC20385_BFb0172E11@ | ILPAINLIGDSVIVGIFYFIGFALFCLEALLSVWVIQRVYLYFRGSGKEA |
| O.sativa_LOC_Os03g38600.1#1 | IFQAINVIGYNGAVGILFFLGFAMFVLETLLSIWVMQKVYWYFRGKGKEA |
| P.patens_147248#1 | IITAIDIFSSNIIIGIFYVVGFALFTLESLLSIWVLKGVVQYFREGAAA |
| P.patens_181545#1 | IIPALDLFSQKLIIGIFYMVGFALYTLETLLSIWVLKSVTQYFREGRAA |
| P.patens_178454#1 | LIPAIDLFGKKLIVGILYAVGFGLYTLEVFLSVWVLKNVSQYFREGCRAA |
| A.cepa_TA5060_4679#1 | --------------------------------------------------- |
| M.truncatula_TA32267_3880#1 | --------------------------------------------------- |
| A.thaliana_AT1G32050.1#1 | VLAAIDVISDSLLAGIFYFIGFGLFCLESLLSLWVLQKIYLYFRGNK--- |
| B.napus_BN06MC16749_45336122@1 | VLAAIDVIRDSLLAGIFYFVGCGLFCLESLLSLWVLQKIYIYFRGNK--- |
| P.trichocarpa_scaff_III.723#1 | ILPAVDVFSDHVLVGIFYLVGFGLFCLESLLSLWVLQKIYMYFRGNK--- |
| P.trichocarpa_scaff_29.268#1 | ILPAVDVISDHLLVGIFYLVGFGLFCLESLLSLWVLQKIYMYFRGHK--- |
| H.vulgare_TA38269_4513#1 | ILAAIDTFSEHLIIGIFYFVGFALFCLETLLSIGVLQKVYMYFRGHK--- |
| T.aestivum_TA75461_4565#1 | ILAAIDTFSEHLIIGIFYFVGFALFCLETLLSIGVLQKVYMYFRGHK--- |
| T.aestivum_TA75459_4565#1 | ILAAIDTFSEHVIIGIFYFVGFALFCLETLLSIGVLQKVYMYFRGHK--- |
| Z.mays_ZM07MC20685_BFb0020D20@ | ILAAIDTFSEHVIIGIFYFVGFALFCLETLLSIGVLQKVYMYFRGNK--- |
| O.sativa_LOC_Os04g50890.1#1 | ILAAIDTFSEHVIIGIFYFVGFALFCLETLLSIGVLQRVYMYFRGNK--- |
| O.sativa_LOC_Os02g47010.1#1 | ILAAIDTFSDHAIVGIFYFVGFALFCLETLVSIWVLQKVYMYFRGHK--- |
| T.aestivum_DR738056#1 | ILPAIDTFSDHAVGILYFVGICLVSMGDRCDHLGSSESIHVFQRAQLKRE |
| O.sativa_LOC_Os08g06440.1#1 | ILVAIEVLTGDMFVGVLYLIGFTFFTLESIISIWVLERVYMHFRGHR--- |
| T.aestivum_TA95653_4565#1 | ----VESIHGEDIVLFLLAIIYAAFGCPLSYILWYRPSVPGHEN------ |

FIGURE 3 (continued)

| | |
|---|---|
| H.vulgare_TA39331_4513#1 | EMKRDATRGAMRAAF--------------- |
| T.aestivum_TA81857_4565#1 | EMKRDATRGAMRAAF--------------- |
| Z.mays_ZM07MC31327_BFb0342A21@ | EMKRDATRGAMRAAF--------------- |
| Z.mays_ZM07MC32029_BFb0293C15@ | EMKRDATRGAMRAAF--------------- |
| O.sativa_LOC_Os07g37740.1#1 | EMKRDATRGAMRAAF--------------- |
| O.sativa_LOC_Os05g42330.1#1 | EMKREAARGALSSAF--------------- |
| Z.mays_ZM07MC22858_BFb0220H23@ | EMKREAARSALSSAF--------------- |
| H.vulgare_TA36210_4513#1 | ------------------------------ |
| O.sativa_LOC_Os01g57220.1#1 | EMKREAARGAMRSAF--------------- |
| Z.mays_ZM07MC27067_BFb0182O18@ | EMKREAARGAMRNAF--------------- |
| T.aestivum_TA51636_4565#1 | ------------------------------ |
| T.aestivum_CK163668#1 | ------------------------------ |
| T.aestivum_TA50955_4565#1 | QMRQEAARGAMRSAF--------------- |
| T.aestivum_TA72069_4565#1 | ELKQQAARGALSSAF--------------- |
| A.thaliana_AT2G20840.1#1 | EMKQEATRRAMMAAL--------------- |
| B.napus_BN06MC09315_42883615@9 | EMKQEATRRAMMAAL--------------- |
| P.trichocarpa_scaff_120.48#1 | EMKREAATRTMMAAL--------------- |
| P.trichocarpa_scaff_XIII.1138# | EMKREAATRTMMAAL--------------- |
| A.thaliana_AT1G03550.1#1 | EMKREATKSTLMRAL--------------- |
| S.lycopersicum_TA43976_4081#1 | EMKKEAARSTMMAAL--------------- |
| A.thaliana_AT1G61250.1#1 | QMRREAARGALRAAV--------------- |
| B.napus_BN06MC05708_42365297@5 | ELRREAARGALRAAV--------------- |
| A.thaliana_AT1G11180.1#1 | DMRRDAARGAMRAAI--------------- |
| M.truncatula_TA20357_3880#1 | ------------------------------ |
| P.sativum_TA772_3888#1 | EMKREAALGAMGAALR-------------- |
| G.max_GM06MC34782_sp08b05@3397 | DMRREPAWEQSGLQYDASIM---------- |
| M.truncatula_TA21989_3880#1 | EMKRDVARGAVRAAF--------------- |
| P.trichocarpa_scaff_XI.291#1 | EMKREAARGALRAAI--------------- |
| S.lycopersicum_TA41016_4081#1 | ------------------------------ |
| O.sativa_LOC_Os03g38590.2#1 | ------------------------------ |
| O.sativa_LOC_Os03g38590.1#1 | EMKREAARSAARAAF--------------- |
| H.vulgare_TA44339_4513#1 | ------------------------------ |
| Z.mays_ZM07MC25122_BFb0162C02@ | EMRREAARGAARAAF--------------- |
| Z.mays_ZM07MC20385_BFb0172E11@ | EMRREAARGAARAAF--------------- |
| O.sativa_LOC_Os03g38600.1#1 | EMRPDAAAGGSRF----------------- |
| P.patens_147248#1 | EMKRNAAASRVAI----------------- |
| P.patens_181545#1 | DMKREAEAGAFRSAV--------------- |
| P.patens_178454#1 | EMKREAAAGAFRSAI--------------- |
| A.cepa_TA5060_4679#1 | ------------------------------ |
| M.truncatula_TA32267_3880#1 | ------------------------------ |
| A.thaliana_AT1G32050.1#1 | ------------------------------ |
| B.napus_BN06MC16749_45336122@1 | ------------------------------ |
| P.trichocarpa_scaff_III.723#1 | ------------------------------ |
| P.trichocarpa_scaff_29.268#1 | ------------------------------ |
| H.vulgare_TA38269_4513#1 | ------------------------------ |
| T.aestivum_TA75461_4565#1 | ------------------------------ |
| T.aestivum_TA75459_4565#1 | ------------------------------ |
| Z.mays_ZM07MC20685_BFb0020D20@ | ------------------------------ |
| O.sativa_LOC_Os04g50890.1#1 | ------------------------------ |
| O.sativa_LOC_Os02g47010.1#1 | ------------------------------ |
| T.aestivum_DR738056#1 | WEKVRNPPVSWTCWGLGILLSNATLDVWQ |
| O.sativa_LOC_Os08g06440.1#1 | ------------------------------ |
| T.aestivum_TA95653_4565#1 | ------------------------------ |

FIGURE 3 (continued)

```
                                                 1                                                            60
        L.esculentum_QC    (1) ------------------------------------------------------MISAGFGSAVCVRPVVSFSNT
            AT2G46910.1    (1) ------------------------------------------------------MDRIASATFSCPAISLSRV
       B.napus_BN06MC20042 (1) ------------------------------------------------------MDRIASVTFSCPAFSTPRV
         P.patens_202760   (1) MSTVLRGGGGGPWLLHPLPCSVAHSLEKAKKKQKQKCSQGAGLRVEAAPRCLSRKLAHC
   P.sitchensis_TA14105_3332 (1) ------------------------------------------------MCKTTLTMDMVVFGCRSLPANFHERTLQ
         O.sativa_AK241632 (1) ------------------------------------------------------MALAAAPLLRLPISPPSPPP
       S.bicolor_Sb01g017450.1 (1) ------------------------------------------------------MALAAPSSLRRLPTTPHVL
          Z.mays_TC447544  (1) ------------------------------------------------------MALAAPSSLRLLPTTPSQAP
  C.solstitialis_TA2061_347529 (1) ------------------------------------------------------MASLPSATATTLFRPPSTSSSMI
        L.virosa_DW148855  (1) ------------------------------------------------------MDLRLPTTALFRPPTTSYILP
       G.hirsutum_TC97719  (1) ------------------------------------------------------MELAFAASVYPTNVKR-VIY
      G.raimondii_TC7628   (1) ------------------------------------------------------MELAFAASVYPTNVKR-VIY
     P.trichocarpa_552393  (1) ------------------------------------------------------MAFATSLYPATGKRPIFK
      M.domestica_TC4908   (1) ------------------------------------------------------MELAlCSPLFPSNATR-GVN
  V.vinifera_GSVIVT00026214001 (1) ------------------------------------------------------MNLAFASTIHLPTGQR-VGY
     G.max_Glyma07g00410.1 (1) ------------------------------------------------------MDMVLHSALYPPSLSCSSST
       G.max_GM06MC19234   (1) ------------------------------------------------------MDMVLHSALYPPSLSCSSST
        N.tabacum_TC21276  (1) ------------------------------------------------------MISGFSSAICTRPNVSFSNT
      T.pratense_TA1297_57577 (1) ------------------------------------------------------MGMDLVFNSSSPVPPLLCSSSS
      C.reinhardtii_190008 (1) ------------------------------------------------------MKTSVYGPSVARATGT
          O.taurii_36262   (1) ------------------------------------------------------MAASRAATTATGAATRGARC
     S.moellendorffii_422148 (1) -----------------------------------------------------------------------
        Chlorella_141300   (1) -----------------------------------------------------------------------
         C.vulgaris_102074 (1) -----------------------------------------------------------------------
              Consensus        M  L                                                    SAL
```

```
                               61                                                                  120
L.esculentum_QC         (22)   IRR----VHNHGRVTC------------LATSMSSASM---------------TVARDAE----YE
AT2G46910.1             (20)   CRISPFGLNIKTNHRK------------RFSCRVAVASGETSA-----------RVVVDNE----LD
B.napus_BN06MC20042     (20)   CRIKPFGLNINTDHRK------------RFSCRVN------TTA----------AKVVDSE----LD
P.patens_202760         (61)   LRDCGGFPLVRIQNGWDSVQPARSRTFDALGAIAEGRE----------------QVQMDHDREQE
P.sitchensis_TA14105_3332 (29) RTRMGAPLHHNKPQMQPTALQLPMISTPLSFGISTKDRRPTRFTYRAYTESSESQVARE
O.sativa_AK241632       (21)   AQTPPPLLACNSVNGVRLRPQRS-----RQPRRAAAA-----------AATASLA----AD
S.bicolor_Sb01g017450.1 (21)   SPPCAYRLRSRPLREPRLCRRLV-----AAAAAATAPL----------ASSPTT-----AD
Z.mays_TC447544         (21)   SPPWASRP--RHLRELRLCQRLATAAAAAAAAATAPL-------------ASSPTTS---AD
C.solstitialis_TA2061_347529 (24) SS----LPLSSSKS-----------RIRCSTTSFT---------------SPQLKKE----SE
L.virosa_DW148855       (23)   SSSTFSFPFSYSRNGF------------RCSMTTTFTS----------------SPPQINE----TE
G.hirsutum_TC97719      (20)   EIRPHSSKLVTNKRRS--------FHK-KFLCSVAVAPDR-------------NRVSE----VE
G.raimondii_TC7628      (20)   EIRPHSSKLVTNKRRS--------FHK-KFLCSVAVAPDR-------------NRVSE----VE
P.trichocarpa_552393    (19)   IINPFTCNAATRRNLT--------VRR-NFSCSATVATDIT------------ARVSE----FE
M.domestica_TC4908      (20)   KIKPYSSMLIASQKLS--------AQK-SFPCLAAVATQA-------------AQTVE----LE
V.vinifera_GSVIVT00026214001 (21) DTRSVSLAPNASRGLS------TQK-MFPCLAATATPT-------------TQAAE----FV
G.max_Glyma07g00410.1   (21)   TGTRWPNSRVGVSLS-------------WRSLSLVPCAL--------------KAYYD----SE
G.max_GM06MC19234       (21)   TGTRWPNSRVGVSLS-------------WRSLSLVPCAL--------------KAYYD----SE
N.tabacum_TC21276       (21)   IRG----VHNHGRVAC------------LATSMSSISM---------------TAARDSE----NE
T.pratense_TA1297_57577 (23)   RRHTHNNYNFNFKCSSNVVNRRRR-RKLLSISMAMPSA---------------AQAYD----SE
C.reinhardtii_190008    (17)   GRAPLVARRSSPTYRP--------SAAAVAS----------------------APVSDGPSTSD
O.taurii_36262          (21)   ASNAPDSSRCRRQSLVSSRRACERRRRSSTAAVHDGVDVAS-------------SSATEADVGDA
S.moellendorffii_422148 (1)    ----------------------------MARLSSCSRASA------------ALQSHQERTRD
Chlorella_141300        (1)    ----------------------------------------------------------------
C.vulgaris_102074       (1)    ----------------------------------------------------------------
Consensus               (61)                                AVA                             E    E
```

FIGURE 5 (continued)

```
                                          121                                                                              180
L.esculentum_QC            (53)  LENRKYELLNIIQDTQRGLVTTADQRSTIEEAMVVVEGFDAG--KEIDLSKLDGTWRLQY
AT2G46910.1                (60)  LEHKKHDLLRAVQDTQRGLTTATSDQRSIIEEALVTVEGFNGG--EEIDPVKLDGTWRLQY
B.napus_BN06MC20042        (55)  LEYKKHDILRAVQETQRGLTATSDQRSLIEEALVTVEGFNGG--EAIDLMKLDGTWRLQY
P.patens_202760           (110)  VERAKMDLLRAVIETKRGVQVTAEQRADIEEALVGVETFNAG--SPLLLDQLHGTWLLQY
P.sitchensis_TA14105_3332  (89)  LQKSKLELLRAAQNTQRGFQASHDQRATIEEAMVSVEQYDAC--IPINLNQLDGTWLLQY
O.sativa_AK241632          (62)  TERRKHELLRAVQETGRGFAASPDQRASIEEAIVSVEELGAGEGSPLDLAALDGTWRLCY
S.bicolor_Sb01g017450.1    (62)  TERRKHELLRAVQETRRGFAAGPDQRAAIEEAVVAVEERGAGKGTPLDLAALDGTWRLCY
Z.mays_TC447544            (68)  TERRKHELLRAVQETRRGFAAGPDQRAAIEEAVVAVEERGAGKGTPIDLAALDGTWRLCY
C.solstitialis_TA2061_347529 (53) LENKKYDLLKAVQDTQRGLVTSPSQRSEIEESLVDLESFEVDGNEAIDLGILDGTWRLQY
L.virosa_DW148855          (58)  LENKKYDLLKAVQDTQRGLTTTPNQRSEIEESLVDLESCRVD-NEPIDLEKLDGTWRLQY
G.hirsutum_TC97719         (58)  LENKKHNLLAVQDTQRGLAATADQRSIIEEALVSVEGYNMG--APLDMAVLDGTWRLQY
G.raimondii_TC7628         (58)  LENKKHNLLAVQDTQRGLAATADQRSIIEEALVSVEGYNMG--APLDMAVLDGTWPLQY
P.trichocarpa_552393       (58)  IENKKNDLLRLVQDTQRGLVTTPDQRSSIEEALVSLEGYNMG--ESVDLVRLDGTWRLQN
M.domestica_TC4908         (58)  VESKKHELLRAIQDTERGLVTTDDQRSFIEEALVSVEGYNMG--APIDLVKLDGTWRLQY
V.vinifera_GSVIVT00026214001 (58) LEEKKHDLLRAIQDTQRGLVATADQRSIIEEALVNVEEYNAG--VPIDIGKLDGTWRLQY
G.max_Glyma07g00410.1      (54)  LENKKHLILLTSVQDTQRGLLTTPDQRSCIEEALVSLEGCNIGS-HPINLSNLDGTWRLQY
G.max_GM06MC19234          (54)  LENKKHLLLTSVQDTQRGLLTTPDQRSCIEEALVSLEGCNIGS-HPINLSNLDGTWRLQY
N.tabacum_TC21276          (52)  LESQKYELLKIIQDTQRGLVTTADQRSIIEEAMVVESFDAG--KEIDLSKLDGTWRLQY
T.pratense_TA1297_575577   (67)  LENKKHELLTSVRDTQRGLTTPLQRSSIEEALVNVEGTNLG--HPIDLNKLDGTWRLQY
C.reinhardtii_190008       (51)  RQQAKQALLDLVKNTNRGLGVRTFTRGLIEEAQIRVESFQGS--ALDFSILGGKWKLIY
O.taurii_36262             (73)  RRRAKARLVDACVGTYRGALTTADDRSAIAEAQGALERIGDG-SETIDFDALDGKWRLAY
S.moellendorffii_422148    (24)  LHKAKMSLLKAVIDTSRGSRASQDQRALLEESMVEVESFDAG--TALDLDKLDGTWLLQY
Chlorella_141300            (1)  ---------------------------MQHQVAVEGYGSG--AELDFGLLEGKWRLEY
C.vulgaris_102074           (1)  -------------MDISLQNDMYVIGPDVGLEALSNR---AIDYTLLPGRWRLIY
Consensus                 (121)  LE KKHELLRAVQDTQRGL  T DQRS IEEALVSVEGFNAG    PIDL LDGTWRLQY
PAP fibrillin PF04755            XXXXXXXXXXXXXXXXXXXXXXXXXXXXXXXXXXXXXXXXXXXXXXXXXXXXXXXXXXXX
```

```
                                    181                                                                           240
L.esculentum_QC              (111) TSAPDVLILFESAARLPF---------------------FQVGQIFQKFECQNESRGG-LVRNVIKWSVP
AT2G46910.1                  (118) TSAPDVVLFEAASRLPF----------------------FQVGQVFQKFECRDRSDGG-IIRNVVQWSLP
B.napus_BN06MC20042          (113) TSAPDVVVLFEAASRFPF---------------------FQVGQIFQKFECRDRSDGG-IIRNVVQWSVP
P.patens_202760              (168) TTAPDVISILQAAEQLPL---------------------LQVGQVYQNFDCRRRTDGG-VVENIVRWSVP
P.sitchensis_TA14105_3332    (147) TSASDVLVLFQAAS-LPF---------------------FQVGQIYQKFECKGCDDGG-IVRNIVRWSVP
O.sativa_AK241632            (122) TSASDVRVLFEAAERLPL---------------------LQVGQIYQKFECKDRSDGG-VVRNVVRWSIE
S.bicolor_Sb01g017450.1      (122) TSASDVLVLFEAAERLPP---------------------LQVGQIYQKFECKDRSDGG-TVRNVVRWSIE
Z.mays_TC447544              (128) TSASDVLVLFEAAERLPL---------------------LQVGQIYQKFECKDRSDGG-TVRNVVRWSIE
C.solstitialis_TA2061_347529 (113) TSASDVLSLLDASARFPF---------------------FQVGQIYQKFECKGQDDGG-YIRNVVRWSIP
L.virosa_DW148855            (117) TSASDVLVLLDSSSRLPF---------------------FQVGQIFQKFECKGKDNGG-YIRNVVRWSIP
G.hirsutum_TC97719           (116) TSAPDVVVLLEAAARLPF---------------------FQVGQIFQKFECRDQLRGG-VIRNVVRWSIP
G.raimondii_TC7628           (116) TSAPDVVVLLEAAARLPF---------------------FQVGQIFQKFECRDQLRGG-VIRNVVRWSIP
P.trichocarpa_552393         (116) TSASDVLVLFESAASLSP---------------------SNVGQIYQKFECRDQSDGG-VIRNVVQWSIP
M.domestica_TC4908           (116) TSASDVLILLEAAERLPF---------------------FQVGQIFQKFECKDQTNGG-VIRNVVRWSIP
V.vinifera_GSVIVT00026214001 (116) TSASDVLILLEAAARFSF---------------------FQVGQIFQKFECQNQSKEG-VVRNVVRWSIP
G.max_Glyma07g00410.1        (113) TSASDVLILLQAAATLPF---------------------FQVGQIFQKFECRDQSNGG-VIRNVVRWSIP
G.max_GM06MC19234            (113) TSASDVLILLQAAATLPF---------------------FQVGQIFQKFECGDQSHGG-VIRNVVRWSIP
N.tabacum_TC21276            (110) TSASDVVILFESAARLPF---------------------FQVGQIFQKFECKSESRGG-LVRNVIKWSVP
T.pratense_TA1297_57577      (125) TSASDVLILFQAAATLPF---------------------FQVGQIFQKFECRDNSNGGVIRNIVQWSIP
C.reinhardtii_190008         (108) TTATDVLPILEAEYQLSPGPFSALGFPRPLEVGNIYQRFTSPVDDEGT--VENIINFKTP
O.taurii_36262               (132) TNASDVLGLLIASRTTGVP--------------------EVGDIFQSFSCKNGKNEG--ITNEIRLSLP
S.moellendorffii_422148      (82)  TSASDVLSILQAG-EFPF---------------------FKAGQIYQKFECKGRFDGG-QVVNVVRSIP
Chlorella_141300             (30)  TTARDVLPLVAPQRLPAP---------------------LQVGRIWQPFSSLEEGRVQ-NIIEAHLPPLP
C.vulgaris_102074            (40)  TTAPDVRPLLIADR-PAP---------------------FQVGNIYQFSDVEQGDVQ--N-IIEFSIP
Consensus                    (181) TSASDVLVLLEAAARLPF                     FQVGQIFQKFECKD SDGG VIRNVVRWSIP
PAP fibrillin PF04755               XXXXXXXXXXXXXXXXXXXXXXXXXXXXXXXXX       XXXXXXXXXXXXXXXXXXXXXXXXXX
C-terminal domain
```

FIGURE 5 (continued)

```
                                         241                                                                              300
L.esculentum QC           (159) RLLEEENE-----GATLIVTARFSSVSARNIYLKFEEIGLQNINISDDLQAVIAPAILPRS
           AT2G46910.1    (166) SLLEEQE------GATLIVTAKFDKVSSRNIYLQFEEISVRNININEQLQALIAPAILPRS
   B.napus_BN06MC20042    (161) SLLEEQE------GATLIVTAKFDKVSSRNIYLQFEEISVRNININEQVQALIAPAILPRS
         P.patens_202760  (216) GLLQENE------GATLIVTAKFSVASARSIVLQRNIYLQFEEARVSEVEISEVLESFIAPALLPRT
    P.sitchensis_TA14105_3332 (194) SILQENE------GATLLVTAKFSLLSQRNIYLQFEEVSVGNLMISEQLQTLIAPAFLPRT
         O.sativa_AK241632 (170) NLLEEQE------GATLMVSAKFAVMSKRNIFLQFEEVVENIKISEQLQALIAPAILPRS
     S.bicolor_Sb01g017450.1 (170) NLLEEQE------GATLMVSAKFVVLSKRNIFLQFEEVAVENIKISEQLQALIAPAILPRS
          Z.mays_TC447544  (176) SLLEENE------GATLLVSAKFSLVSRRNIYLQFEEIAVQNINISEELQALIAPAILPRS
 C.solstitialis_TA2061_347529 (161) RLLEDNE------GATLLVSAKFSIVSRRNIYLQFEEISLQNINISDELQALIAPAILPRS
       L.virosa_DW148855   (165) NLLEEQE------GATLLVVSAKFDVVSVRNIYLQFEEIKVQDINISEQLQALIAPAILPRS
       G.hirsutum_TC97719  (164) NLLEEQE------GATLLVSAKFDVVSRNIYLQFEEIKVQNINISEQLQALIAPAILPRS
      G.raimondii_TC7628   (164) NLLEEQE------GATLLVSAKFNVVSARNIYLQFEEISIQNRISEELQALIAPAILPRS
    P.trichocarpa_552393   (164) TLLEEQE------GATLLVSAKFSVVSVRNIYLQFKEINVQDIKISEELQALIAPAILPRS
      M.domestica_TC4908   (164) PLLEEQE------GATLLVSAKFSVVSVRNIYLQFEEISIQSINISEELQALIAPAILPRS
 V.vinifera_GSVIVT00026214001 (164) PLLEEQE------GATLLVSAKFSVVSARNIYLQFEEITIQDINISEELRALIAPAILPRS
     G.max_Glyma07g00410.1 (161) NLLEEQE------GATLLVSAKFNVVSVRNIYLQFQEITIQDINISEELRALIAPAILPRS
        G.max_GM06MC19234  (161) NLLEEQE------GATLLVSAKFNVVSVRNIYLQFQEITIQDINISEELRALIAPAILPRS
      N.tabacum_TC21276    (158) RLLEENE------GATLLVSARFSCVSARNIYLKFEEIGLQNINISEDLQAVIAPAILPRS
    T.pratense_TA1297_57577 (174) NLLEEQE------GATLLVSAKFTLVSVRNIYLQFQEITVQDINISEQLQALIAPAILPRS
      C.reinhardtii_190008 (166) ASS---------LVFTVGARYDVRSGKRIALVFEDARLGDIQLSDGAEALLAPALLPRG
           O.taurii_36262 (179) FILSEAKRGEPGGVGLRVQASYEDIGRRRLRITFQEAKVSEINISPLAFTLLAPAILPRG
    S.moellendorffii_422148 (129) GLLQDGE------GATLFVTAGFSVVSARTIQLEFKEARLGEVLISEELQALLAPAVLPRT
         Chlorella_141300 (78)  LIGAAGL------GLSLVEAGYEARTARSIALTFRQAGFRDVELSPELQNLLASPLLPRG
        C.vulgaris_102074  (84)  MLLQKG-------TVEVRAKYDIRSPQRIRLMFQEAGVRNLSITDELELLLAPAILPRS
                Consensus (241) LLEEQE      GATLLVSAKF VVS RNIYLQFEEI VQNINISEELQALIAPAILPRS
         C-terminal domain       xxxxxxxxxxxxxxxxxxxxxxxxxxxxxxxxxxxxxxxxxxxxxxxxxxxxxxxxxxxx
```

FIGURE 5 (continued)

```
                                    301                                                             360
     L.esculentum_QC  (214) FLSLQILQFIRSFKARVPVTSPE-----------RHSVGGLYYLSYLDKNMLLGRAVGGG
        AT2G46910.1  (221) FLSLQLLQFIRTFKAQIPVNATSP----------GRRSVGGLYYLSYLDNNMLLGRSVGGG
    B.napus_BN06MC20042 (216) FINLQILQFIRTFNAQIPVTATSP----------GRRSVGGLYYLSYLDNNMLLGRSVGGG
       P.patens_202760 (271) FINIQILQFLRGLDIRFPLARGSQGLQTLPENSRRAPIGLWYNLTFLDNNMLVGRALGNG
   P.sitchensis_TA14105_3332 (249) SLSLETLQLLRSFETKIPLLGNSDEQ--------ADRRPSPGGLYYLSYLDRDMLLGRALGGG
       O.sativa_AK241632 (225) FFSLQILQFLKTFRAQVPVNGPE-----------RRSPGGLYYLSYLDRDMLLGRSVGGG
    S.bicolor_Sb01g017450.1 (225) FLSLQILQFLKTFRAQVPVGGPE-----------RRSPGGLYYLSYLDRDMLLGRSVGGG
       Z.mays_TC447544 (231) FLSLQILQFLKTFRTQVPVSGPE-----------RRSPGGLYYLSYLDRNMLLGRSVGGG
  C.solstitialis_TA2061_347529 (216) FLTLQVLQAIRTFKAQVPVSSTSP----------GRRSVGGLYYLSYLDRNMLVGRAVGGG
      L.virosa_DW148855 (220) FLTLQILQFLRTFRAQVPVSTTSP----------GRQSVGGLYYLSYLSYLDQNMLLGRAFGGG
     G.hirsutum_TC97719 (219) FLSLQILQFLRTFRAQVPVRNPGT----------GRRSVGGLYYLSLSFLDQNMLLGRAFGGG
    G.raimondii_TC7628 (219) FLSLQILQFLRTFRAQVPVRNPGT----------GRRSVGGLIYSLSFLDQNMLLGRAFGGG
    P.trichocarpa_552393 (219) FLSLQILQFIRTFKAHVPVRNPGDP---------GRRSVGGLYYLSYLDRNMLLGRAVGGG
    M.domestica_TC4908 (219) FLSLQILQYLRTFKAQIPVRDPGS----------RQSVGGLYYLSYLDANMLLGRAVGGG
  V.vinifera_GSVIVT00026214001 (219) FISLQILQFIRTFKAEIPVRNQG-----------RRSVGGLYYLSYLDANMLLGRAAAGG
  G.max_Glyma07g00410.1 (216) FISLQILQFLRTFKAQIPVRDPG-----------RQSVGGLYYLSYLDDNMLLGRAVGGG
     G.max_GM06MC19234 (216) FISLQILQFLRTFKAQIPVRDPG-----------RQSVGGLYYLSYLDDNMLLGRAVGGG
    N.tabacum_TC21276 (213) FLSLQILQFISRFKAQVPVTSPE-----------RRSVGGLYYLSYLDDNMLLGRAVGGG
   T.pratense_TA1297_57577 (229) FINLQILQYLRAFKAQIPVSP-G-----------RESVGGLYYLSYLDDNMLLGRAVGGG
  C.reinhardtii_190008 (216) SLQHQLLLAIKEFTLKFQFRTAAQLAS--QAVTRAGSAAAGYLLTYLDNDMLIGRAIGLG
      O.taurii_36262 (239) SLNHQVLMFIKELELKFPLRGALTSIG--GGEPSGGAAVGSYHLTVDEDVLVGRAQAGG
   S.moellendorffii_422148 (184) FLNLQILQTLQAINSLDVRVPLR-GRR-------PSNERRS-LGLLYYLTYLDMLLGRAIGSG
      Chlorella_141300 (133) WWNQQLLLALKQLSGSVPLTSRLPGTTSDQ----QRPVGLNYMLTYLDEDMLIGRAQGNG
    C.vulgaris_102074 (136) WLNHQVLLALREAEVFVPLRARLPALFQSASTSLERNFGSDYLLITYLDDTLIGSQTGSG
             Consensus (301) FLSLQILQFLRTFKAQVPV           RRSVGGLYYLSYLD NMlLGRAVGGG
       C-terminal domain       XXXXXXXXXXXXXXXXXXXXXXXXXXXXXXXXXXXXXXXXXXXXXXXXXXXXXXXXXXXX
```

FIGURE 5 (continued)

```
                              361                                377
L.esculentum QC         (263) GVFIFTRAHTLIY-------
         AT2G46910.1    (272) GVFVFTKSQPLEL-------
   B.napus_BN06MC20042  (267) GVFVFTKSQPLEL-------
       P.patens_202760  (331) GIFIFSRTQARPKSV-----
P.sitchensis_TA14105_3332 (304) GIFIFSRTQPFQV-------
       O.sativa_AK241632 (274) GVFIFTRAQPLL--------
    S.bicolor_Sb01g017450.1 (274) GVFVFTKAQPLT--------
         Z.mays_TC447544 (280) GIFVFTKAQPLT--------
C.solstitialis_TA2061_347529 (267) GVFVFTRAQNIL--------
      L.virosa_DW148855 (271) GVFVFTRAQNFV--------
    G.hirsutum_TC97719  (270) GVFVFTKAQPLEL-------
   G.raimondii_TC7628   (270) GVFVFTKAHPLEL-------
  P.trichocarpa_552393  (271) GVFVFTRAQPIDL-------
    M.domestica_TC4908  (269) GVFVFTKAQPLK--------
V.vinifera_GSVIVT00026214001 (268) -IFVFTRAQPLV--------
    G.max_Glyma07g00410.1 (265) GVFVFTRAQSLY--------
     G.max_GM06MC19234  (265) GVFVFTRAQSLY--------
    N.tabacum_TC21276   (262) GVFVFTRAQALTF-------
   T.pratense_TA1297_57577 (277) GVFVFTRAQSLY--------
  C.reinhardtii_190008  (274) GVFVFVREE-----------
        O.taurii_36262  (297) -VYIFTRAEL----------
S.moellendorffii_422148 (237) GVFVFGKTQSF---------
      Chlorella_141300  (189) GVFVFTRDAEAQEAAH----
      C.vulgaris_102074 (196) GTFIFVRD------------
           Consensus    (361) GVFVFTRAQ L
                              XXXXXXXXXXXX
         C-terminal domain
```

FIGURE 5 (continued)

Conserved Domain X
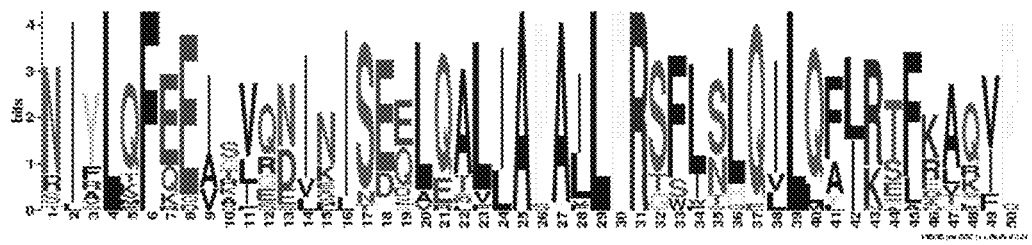
Conserved Domain Y
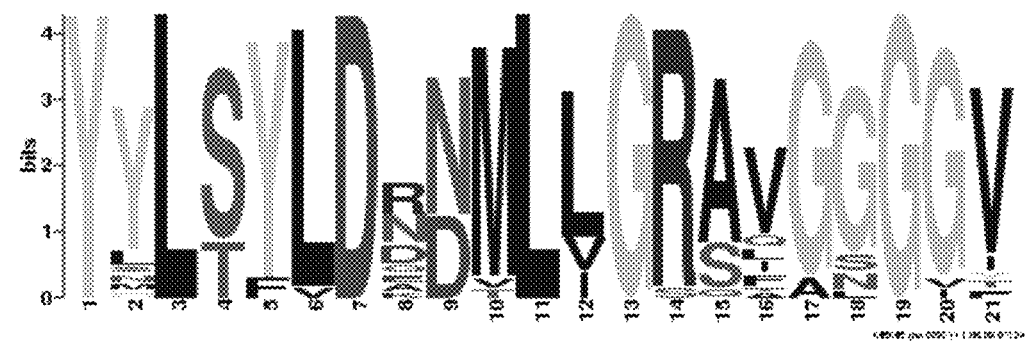
Conserved Domain Z
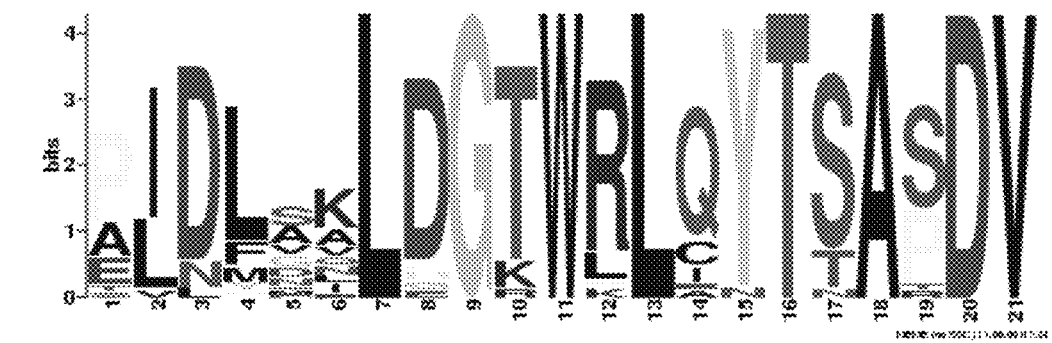
FIGURE 8

```
MGTQKPAWLEALYAQKFFVGCSYHETAKKNEKNVCCLDCCISICPHCIPSHRFHRL
                         ----12-----              --11--
          ---------------15----------------------   --13--
              -------------------17-----------------------
LQVRRYVYHDVVRLEDIEKLIDCSNVQAYTINSAKVVFIKKRPQNRQFKGAGNYCT
---------11------------  -----------10--------        --
---------13--------------                         ----14---
         ------------------16--------------------------
SCDRSLQEPFAHCSLGCKVDFVLKHYKDLSPYLRRCNTLTLGPDFFIPQDLADDEM
-----------18-------------------------------------
--------14---------

TNETPHSTIVDSDEPMSWSSSSSGSENMSMASSEIVRKKRSGLYVCARSMNKVSDE

DIASSMSRRKGIPHRSPLC
```

FIGURE 10

CLUSTAL 2.0.11 multiple sequence alignment

```
Pt583639           ---MGTQKPAWLEALYAQKFFVGCSYHETAKKNEKNVCCLDCCISICPHCIPSHRFHRLL
Pt779642           ---MGIQKPAWLGALYTQKFFAGCSYHEAAKKNEKNVCCLDCCISICPHCIPSHRFHRLL
Os02g09070.1       ----MWKPAWLEALNTQKFFIACSFHEHAKKNEKNICCLDCCTSICPHCVAAHRVHRLL
Zm376              MIMQAMWKPGWLEALDTQKFFVACSFHEHAKKNEKNICCLDCCTSICPHCVAAHRAHRLL
Sb04g005680.1      -MIMAMWKPAWLEALNTQKFFVACSLHEHAKKNEKNICCLDCCTSICPHCVGAHRVHRLL
TaTC339412         MHQQAMWKPAWLEALSTEKFFVACSFHEHAKKNEKNICCLDCCTSICPHCVSTHRVHRLL
NtTC27363          ---MGIQKPAWLEAMCTEKFFAPCPIHESAKKNEKNICCLDCCISICPHCVMAHRFHRLV
VvT00005658001     -MIMGIQKPAWLEALYTQKFFVSCSIHETAKKNEKNILCLDCCTSICPHCLQFHRFHRLV
Gm13g23360.1       -MIMGHQKPAWLEALYTQKFFVGCSYHENAKKNEKNVFCLDCCTSICPHCLPSHRFHRLL
Gm17g11470.1       -MIMGYQKPAWLEALYTQKFFVGCSYHEKFAGCSYHENAKKNEKNVCCLDCCTSICPHCLPSHRFHRLL
MtAC152347_6.5     -MIMGCQKPSWLEALYTEKFFAGCSYHENAKKNEKNVCCLDCCTSICPHCFPSHRYHRLL
Gm09g12330.1       -MIMGHQKPAWLEALYAQKFFVGCSHHENAKKNEKNICCLDCCTSICPHCLPSHRCHRLL
AT2G12646.1        ---MGIQKPAWLDALYAEKFFVGCPYHETAKKNERNVCCLDCCTSLCPHCVPSHRFHRLL
AsTA310_217475     -MIMGY-KPAWLEAPYREKFFVGCSYHEKAKKNEKNVCCLDCCISICPHCFPSHRFHRLL
                     **.**  .  :*** *. .** *.********:*: ******.*::*****:

Pt583639           QVRRYVYHDVVRLEDIEKLIDCSNVQAYTINSAKVVFIKKRPQNRQFKGAGNYCTSCDRS
Pt779642           QVRRYVYHDVVRLEDLEKLIDCSNVQAYTINSAKVVFIKKRPQNRQFKGAGNYCTSCDRS
Os02g09070.1       QVRRYVYHDVVRLEDLEKLIDCSSVQSYTINSSKVVFLKKRPQNRQFKGSGNICTSCDRS
Zm376              QVRRYVYHDVVRLEDLEKLIDCSSVQSYTINSSKVVFLKKRPQNRQFKGSGNICTSCDRS
Sb04g005680.1      QVRRYVYHDVVRLEDLEKLIVDCSSVQSYTINSSKVVFLKKRPQNRQFKGSGNICTSCDRS
TaTC339412         QVRRYVYHDVVRLEDLEKLIDCSGVQSYTINSSKVVFLKKRPQNRQFKGSGNICTSCDRS
NtTC27363          QIRRYVYHDVVRLEDLEKLIDCSNVQAYTINSAKVIFIKKRPQNRQFKGSGNYCTSCDRS
VvT00005658001     QVRRYVYHDVVRLEDLEKLIDCSNVQAYTINSAKVVFIKKRPQNRQFKGSGNYCTSCDRS
Gm13g23360.1       QVRRYVYHDVVRLEDLQKLIDCSNVQAYTINSAKVVFIKKRAQNRQFKGAGNYCTSCDRS
Gm17g11470.1       QVRRYVYHDVVRLEDLQKLIDCSNVQAYTINSAKVVFIKKRPQNRQFKGAGNYCTSCDRS
MtAC152347_6.5     QVRRYVYHDVVRLEDLQKLIDCTNVQAYTINSAKVVFIKKRPQNRQFKGSGNYCTSCDRI
Gm09g12330.1       QVRRYVYHDVVRLEDLQKLIDCSNVQPYTINSAKVVFIKKRPQNRQLKGSANYCTSCDRS
AT2G12646.1        QVRRYVYHDVVRLEDLQKLIDCSNVQAYTINSAKVVFIKKRPQNRQFKGAGNYCTSCDRS
AsTA310_217475     QVRRYVYHDVVRLEDLQKLIDCSNVQPYTINSAKVVFIKNRPQNRQFKSSGNYCTSCDRS
                   *:************:*:**:*.**.******:**:*** ****** . ..* *******
```

| | |
|---|---|
| Pt583639 | K------VSDE--DIASSMS-RRKGIPHRSPLC |
| Pt779642 | K------VSDE--DMASSMS-RRKGIPHRSPLC |
| Os02g09070.1 | R------VSDD--DMATNMS-RRKGVPHRSPLC |
| Zm376 | R------VSEE--DMATNMS-RRKGVPQRSPLC |
| Sb04g005680.1 | R------VSDE--DMATNMS-RRKGVPHRSPLC |
| TaTC339412 | R------VSDD--DMATNMS-RRKGVPQRSPLC |
| NtTC27363 | NSNYKNLSSDE--DMATSMS-RRKGIPHRSPLC |
| VvT00005658001 | K------VSEE--DMATSMS-RRKGIPHRSPMC |
| Gm13g23360.1 | NSN----KVSDE--DMATSMS-RRKGIPHRSPLC |
| Gm17g11470.1 | NSN----KVSDE--DMAISMS-RRKGIPHRSPLC |
| MtAC152347_6.5 | NSNS-NKVSDE--DMATSMISRRKGVPHRSPLC |
| Gm09g12330.1 | N------KVSHE--DMVTSIS-RRKGIPHRSPLC |
| AT2G12646.1 | SYK---EVSEDPDDISACIN-RRKGVPQRSPLC |
| AsTA310_217475 | ------------IREH---------EHGLQY---- |
| | .:      .:          :*: |

FIGURE 11 (continued)

```
MVNLRSPRFLVLYAFQFLVLVQIQVSCYQYKVGDLDAWGIPTSANPQVYTYWSKYHTLKIGDSLLFLYPPSQDSVIQV
                                                                       <-----
                                         <---------21---------->
                                         <---------23---------->
                                                                          <-----
                                                                          <-----
                                  <-------------26------------->
                 <------27------>
                                                          <---------------------
               <---------30---------->

TRENYNSCNLTDPILYMNNGNSLFNITAYGDFYFTSGVQGHCQKKQKLHISVPGNGSASAYSPSYGPSALPDSAPSYP
---19-------->
                                  <----20--->
                 <-----------22--------------->
----24------->
--------------25------------------------------->

--28-------------------------->
                            <--------29---------->

TVFGSIPLPPSSSPLNRFSILLSFIIGAGIWAIIM
```

FIGURE 14

MYRAAASLASKARQAGSSARQVGSRLALSRNYAAKDIKFGVEARA

LMLRGVEELADAVKVTMGPKGRNVVIEQSYGSPKVTKDGVTVAKS
- - - - - - - - - -34- - - - - - - - - - - - - - -    - - - -35- - -
IEFKDRVKNVGASLVKQVANATNDTAGDGTTCATVLTKAIFTEGC
35-     - - - - -36- - - - - - - -    - - - - -37- - - - - - - -
KSVAAGMNAMDLRRGISMAVDAVVTNLKGMARMISTSEEIAQVGT
- - - -37- - - - - - - -                                              -
ISANGEREIGELIAKAMEKVGKEGVITIADGNTLYNELEVVEGMK
-38- -                      - - - - - -39- - - - - -
LDRGYISPYFVTNPKTQKCELDDPLILIHDKKVSSLHAVVKVLEL
    - - - - -40- - - -
ALKKQRPLLIVAEDVESEALGTLIINKLRAGIKVCAVKAPGFGEN
         - - - -41- - - -                                - - -42- - -
RKANLQDLAILTGGEVITEELGMNLEKFEPQMLGTCKKVTVSKDD
-                                                                     - -
TVILDGAGDKKSIEERAEQIRSAIELSTSDYDKEKLQERLAKLSG
- - - - - -41- - - - - - - -
GVAVLKIGGASEAEVGEKKDRVTDALNATKAAVEEGIVPGGVAL

LYASKELDKLPTANFDQKIGVQIIQNALKTPVHTIASNAGVEGAV
            - - - -42- - - - -
VVGKLLEQDNTDLGYDAAKGEYVDMVKAGIIDPLKVIRTALVDAA
         - - - - - - -43- - - - - - - -
SVSSLMTTTESIIVEIPKEEKEAPAMGGMGGMDY
                                            -43-

FIGURE 17

```
P.patens_226792              ------------------------------------------------
P.patens_233067              ------------------------------------------------
P.patens_163173              ------------------------------------------------
P.patens_56767               ------------------------------------------------
S.lycopersicum_TC192865      ------------------------------------------------
L.esculentum_gl_39           ------------------------------------------------
S.lycopersicum_TC197855      ------------------------------------------------
A.thaliana_AT3G23990         ------------------------------------------------
A.thaliana_AT2G33210         ------------------------------------------------
O.sativa_Os10g32550.1        MLLEPPRVFSSLIKSPRPPLFDPPQEKKRLHSSTSSPPPLTSPPLPSLLL
O.sativa_glomalin_SEQID2     ------------------------------------------------
O.sativa_glomalin_39         ------------------------------------------------
O.sativa_Os03g04970.1        ------------------------------------------------
Z.mays_ZM07MC32795           ------------------------------------------------
T.aestivum_c54647991         ------------------------------------------------
A.cepa_CF435092              ------------------------------------------------
P.trichocarpa_sc_I.447       ------------------------------------------------
P.trichocarpa_sc_III.1436    ------------------------------------------------
M.truncatula_AC161864_24     ------------------------------------------------
M.truncatula_AC161864_3      ------------------------------------------------
A.thaliana_AT3G13860.1       ------------------------------------------------
P.trichocarpa_sc_44.102      ------------------------------------------------
S.lycopersicum_TC204816      ------------------------------------------------
O.sativa_Os05g46290          ------------------------------------------------
Z.mays_ZM07MC22894           ------------------------------------------------

P.patens_226792              ----------MYRAAAALASRVNRGRSL---VQNFSK------LQSTRHF
P.patens_233067              ----------MYRAAATLSARINRGRAL---VQNFNK------LQSTRNF
P.patens_163173              ----------MYRVAAALASRVSRGQSL---VQAC-R------LQSARKF
P.patens_56767               ----------MFRAAAALAAHV-RFRPL---VRNFDH------FQLVRWF
S.lycopersicum_TC192865      ----------MYRFAANLASKASVARTS--SQKIGGR------LNWSRNY
L.esculentum_gl_39           ----------MYRFAANLASKASVARTS--SQKIGGR------LNWSRNY
S.lycopersicum_TC197855      ----------MYRFAAKLASKSRVARSS--TQQVGSR------LNWSRNY
A.thaliana_AT3G23990         ----------MYRFASNLASKARIAQN---ARQVSSR------MSWSRNY
A.thaliana_AT2G33210         ----------MYRLVSNVASKARIARKC--TSQIGSR------LNSTRNY
O.sativa_Os10g32550.1        PSPRSLLGSAMYRAAASLASKARQAGSS--ARQVGSR------LALSRNY
O.sativa_glomalin_SEQID2     ----------MYRAAASLASKARQAGSS--ARQVGSR------LALSRNY
O.sativa_glomalin_39         ----------MYRAAASLASKARQAGSS--ARQIGSR------LALHRNY
O.sativa_Os03g04970.1        ----------MYRAAASLASKARQAGSS--ARQIGSR------LALHRNY
Z.mays_ZM07MC32795           ----------MYRAAVSLASKARQAGSSSAARQVGSR------LAWSRNY
T.aestivum_c54647991         ----------MYRAASLASKARLAGSS---ARQVGSR------LAWSRNY
A.cepa_CF435092              ----------MYRPALYAASKARSACIS--GKQVGSR------LSWRRNY
P.trichocarpa_sc_I.447       ----------MHRFTSSLASKARIARSS--TNQIGSR------LSWSRNY
P.trichocarpa_sc_III.1436    ----------MHRFTSSLASKARIARST--TKQIGSR------LSWSRNY
M.truncatula_AC161864_24     ----------MYRFASSLASKARIARSN--ANQIGSR------VAWSRNY
M.truncatula_AC161864_3      ----------MYRFASSLASKARIARNN--VQQVGSR------VAWNRNY
A.thaliana_AT3G13860.1       ----------MYRVLSKLSS--SIGSSTS-RKLVSGR------IISSRNY
P.trichocarpa_sc_44.102      -----MEQLIILYCASFVFLS--FHSSSAS-KKQLSSR------VTYSRSY
S.lycopersicum_TC204816      ----------MFRAAAVAS--SIRFSTS-RKLVSSR------IISSRNY
O.sativa_Os05g46290          ----------MYRAAAAAASSISRSSSAL-RKQLSRGGCGEQ-RLWARGY
Z.mays_ZM07MC22894           ----------MYRAAAV----ISRSSSAL-RRQLARGVAGELPRLLARGY
                                        :                                *  :
```

FIGURE 18

```
P.patens_226792              SA--KDIRFGVEARALMLQGVEQLADAVQVTMGPKGRTVIIEQSFGSPKV
P.patens_233067              SA--KDIRFGVEARALMLQGVEQLADAVQVTMGPKGRTVVIEQSFGSPKV
P.patens_163173              SG--KDIRFGVEARALMLQGVEQLADAVQVTMGPKGRTVIIEQSFGSPKV
P.patens_56767               SA--KDTRFGVEARALMLQGVEQLADAVQVTMGPKGRTVVLEQSYGSPKI
S.lycopersicum_TC192865      AA--KDIRFGVEARALMLQGVEQLADAVKVTMGPKGRNVVIEQSWGAPKV
L.esculentum_gl_39           AA--KDIRFGVEARALMLQGVEQLADAVKVTMGPKGRNVVIEQSWGAPKV
S.lycopersicum_TC197855      AA--KDIKFGVEARGIMLQGVEQLADAVKVTMGPKGRNVVIEQSWGAPKV
A.thaliana_AT3G23990         AA--KEIKFGVEARALMLKGVEDLADAVKVTMGPKGRNVVIEQSWGAPKV
A.thaliana_AT2G33210         AA--KDIRFGVEARALMLRGVEDLADAVKVTMGPKGRNVIIEQSWGAPKV
O.sativa_Os10g32550.1        AA--KDIKFGVEARALMLRGVEELADAVKVTMGPKGRNVVIEQSYGSPKV
O.sativa_glomalin_SEQID2     AA--KDIKFGVEARALMLRGVEELADAVKVTMGPKGRNVVIEQSYGSPKV
O.sativa_glomalin_39         AA--KDIKFGVEARALMLRGVEELADAVKVTMGPKGRTVVIEQSFGAPKV
O.sativa_Os03g04970.1        AA--KDIKFGVEARALMLRGVEELADAVKVTMGPKGRTVVIEQSFGAPKV
Z.mays_ZM07MC32795           AA--KDIKFGVEARALMLRGVEELADAVKVTMGPKGRNVVIEQSFGAPKV
T.aestivum_c54647991         AA--KDIRFGVEARAMMLKGVEDLADAVKVTMGPKGRTVIIEQSFGAPKV
A.cepa_CF435092              AA--KDIRFGVDARALMLKGVEELADAVKVTMGPKGRNVVIEQSFGAPKV
P.trichocarpa_sc_I.447       AA--KDIRFGVEARAGMLKGVEELADAVKVTMGPKGRNVVIEQSYGAPKV
P.trichocarpa_sc_III.1436    AA--KDIRFGVEARAVMLKGVEELADAVKVTMGPKGRNVVIEQSFGAPKV
M.truncatula_AC161864_24     AA--KEIKFGVEARALMLKGVEELAEAVKVTMGPKGRNVVIEQSFGAPKV
M.truncatula_AC161864_3      AA--KEIKFGVEARALMLKGVEDLAEAVKVTMGPKGRNVVIEQSFGAPKV
A.thaliana_AT3G13860.1       AA--KDISFGIGARAAMLQGVSEVAEAVKVTMGPKGRNVIIESSYGGPKI
P.trichocarpa_sc_44.102      VA--KDINFGVGARAAMLQGVNEVAEAVKVTMGPKGRHVIIEKS------
S.lycopersicum_TC204816      AA--KDISFGSHARLAMLQGVNELAEAVKVTMGPKGRNVIIEKSPGNPKV
O.sativa_Os05g46290          AA--KEVAFGVGARAALLQGVNDLADAVKVTMGPKGRNVIIERSHRAPKV
Z.mays_ZM07MC22894           AATAKEVSFGVGARAAMLQGVNDLADAVKVTMGPKGRTVIIEGSHKGPKV
                               .*::  **   **    :*:**.::*:**:******* *::*  *

P.patens_226792              TKDGVTVAKAIEFKDRLQNVGASLVKSVASSTNDVAGDG------TTCAT
P.patens_233067              TKDGVTVAKAIEFKDRLQNVGASLVKSVASSTNDVAGDG------TTCAT
P.patens_163173              TKDGVTVAKSIEFKDRLKNVGASLVKSVANSTNDVAGDG------TTAAT
P.patens_56767               TKDGVTVAKSIEFKDKLKNVGASLVKSVANATNDVAGDG------TTAAT
S.lycopersicum_TC192865      TKDGVTVAKSIEFKDKIQNVGASLVKQVANATNDVAGDG------TTCAT
L.esculentum_gl_39           TKDGVTVAKSIEFKDKIQNVGASLVKQVANATNDVAGDG------TTCAT
S.lycopersicum_TC197855      TKDGVTVAKSIEFKDKIKNVGASLVKQVANATNDVAGDG------TTCAT
A.thaliana_AT3G23990         TKDGVTVAKSIEFKDKIKNVGASLVKQVANATNDVAGDG------TTCAT
A.thaliana_AT2G33210         TKDGVTVAKSIEFKDRIKNVGASLVKQVANATNDVAGDG------TTCAT
O.sativa_Os10g32550.1        TKDGVTVAKSIEFKDRVKNVGASLVKQVANATNDTAGDG------TTCAT
O.sativa_glomalin_SEQID2     TKDGVTVAKSIEFKDRVKNVGASLVKQVANATNDTAGDG------TTCAT
O.sativa_glomalin_39         TKDGVTVAKSIEFSNRVKNVGASLVKQVANATNDTAGDG------TTCAT
O.sativa_Os03g04970.1        TKDGVTVAKSIEFSNRVKNVGASLVKQVANATNDTAGDG------TTCAT
Z.mays_ZM07MC32795           TKDGVTVAKSIEFKDRVKNVGASLVKQVANATNDTAGDG------TTCAT
T.aestivum_c54647991         TKDGVTVAKSIEFKDRVKNVGASLVKQVANATNDTAGDG------TTCAT
A.cepa_CF435092              TKDGVTVAKSIEFKDRVKNMGASLVKQVANATNDSAGDG------TTCAT
P.trichocarpa_sc_I.447       TKDGVTVAKSIEFKDKVKNVGASLVKQVANATNDAAGDG------TTCAT
P.trichocarpa_sc_III.1436    TKDGVTVAKSIEFKDKVKNVGASLVKQVANATNDAAGDG------TTCAT
M.truncatula_AC161864_24     TKDGVTVAKSIEFKDKVKNIGASLVKQVANATNDVAGDG------TTCAT
M.truncatula_AC161864_3      TKDGVTVAKSIEFCKVKNIGASLVKQVANATNDVAGDG------TTCAT
A.thaliana_AT3G13860.1       TKDGVTVAKSISFQAKAKNIGAELVKQVASATNKVAGDG------TTCAT
P.trichocarpa_sc_44.102      -KDGVTVAKSIKFKEKAKSVGADLVKQVANATNTATGDGDLSTSCTTCAT
S.lycopersicum_TC204816      TKDGVTVAKSINFKEKAKNVGADLVKQVANATNSVAGDG------TTCAT
O.sativa_Os05g46290          TKDGVTVAKSIEFEDSAKNVGANLVKQVAEATNKVAGDG------TTCAT
Z.mays_ZM07MC22894           TKDGVTVAKSVEFEDSAKNVGANLVKQVADATNKAAGDG------TTCAT
                              ********::.*.    :..**.***.**.:**   :***      **.**
```

FIGURE 18 (continued)

```
P.patens_226792            VLTRAIFVEGCKSVAAGMNAMDLRRGISVAVDAVVSYLKSQAKMISTSEE
P.patens_233067            VLTRAIFVEGCKSVAAGMNAMDLRRGINLAVDSVVSHLKSQAKMISTSEE
P.patens_163173            VLTRAIFAEGCKSVAAGMNAMDLRRGINLAVEAVVAHLKSQAKMISTSEE
P.patens_56767             VLARAIFTEGCKSVAAGMNAMDLRRGITLAVDAVVAHLKSQAKMISTSEE
S.lycopersicum_TC192865    VLTRAIFAEGCKSVAAGMNAMDLRRGITMAVDSVVTNLKSRARMISTSEE
L.esculentum_gl_39         VLTRAIFAEGCKSVAAGMNAMDLRRGITMAVDSVVTNLKSRARMISTSEE
S.lycopersicum_TC197855    VLTRAIFAEGCKSVAAGMNAMDLRRGITMAVDAVVTNLKSRARMISTSEE
A.thaliana_AT3G23990       VLTRAIFAEGCKSVAAGMNAMDLRRGISMAVDAVVTNLKSKARMISTSEE
A.thaliana_AT2G33210       VLTRAIFTEGCKSVAAGMNAMDLRRGIKLAVDTVVTNLQSRARMISTSEE
O.sativa_Os10g32550.1      VLTKAIFTEGCKSVAAGMNAMDLRRGISMAVDAVVTNLKGMARMISTSEE
O.sativa_glomalin_SEQID2   VLTKAIFTEGCKSVAAGMNAMDLRRGISMAVDAVVTNLKGMARMISTSEE
O.sativa_glomalin_39       VLTKAIFAEGCKSVAAGMNAMDLRRGISMAVDEVVTNLKGMARMISTSEE
O.sativa_Os03g04970.1      VLTKAIFAEGCKSVAAGMNAMDLRRGISMAVDEVVTNLKGMARMISTSEE
Z.mays_ZM07MC32795         VLTKAIFTEGCKSVAAGMNAMDLRRGISMAVDAVVTNLKGMARMISTSEE
T.aestivum_c54647991       VLTKAIFTEGCKSVAAGMNAMDLRRGISMAVDDVVTNLKGMARMINTSKE
A.cepa_CF435092            VLTKAIFSEGCKSVAAGMNAMDLRRGITMAG--------------------
P.trichocarpa_sc_I.447     VLTQAIFTEGCKSVAAGMNAMDLRRGISMAVESVVTNLKSRARMISTSEE
P.trichocarpa_sc_III.1436  VLTRAIFAEGCKSVAAGMNAMDLRR------------------------E
M.truncatula_AC161864_24   VLTRAIFTEGCKSVAAGMNAMDLRRGINMAVDAVVTNLKSRARMISTSEE
M.truncatula_AC161864_3    ILTRAIFSEGCKSVAAGMNAMDLRRGINMAVDAVVTSLKSRARMISTSEE
A.thaliana_AT3G13860.1     VLTQAILIEGCKSVAAGVNVMDLRVGINMAIAAVVSDLKSRAVMISTPEE
P.trichocarpa_sc_44.102    VLTQAILVEGCKSVSAGVNVMDLRSGINIAVGGVLSDLKKRALMISTPEE
S.lycopersicum_TC204816    VLTQAIFTEGCKAVAAGVSVMDLRNGINMAIDAVVADLKSRAVMISTPEE
O.sativa_Os05g46290        VLTQAILTEGCKAVAAGVNVMDLRNGINKAISSITTHLKSKAWIINSSEE
Z.mays_ZM07MC22894         VLTQAILTEGCKAVAAGVNVMDLRNGINKAINAITAHLKSKAWKINSPEE
                           :*::**: ****:*:**:..****

P.patens_226792            IAQVGTISANGDREIGDLLARAMEKVGKEGVITVSDGKTLFNELEVVEGM
P.patens_233067            IAQVGTISANGDSEIGDLLARAMEKVGKEGVITVSDGKTLFNELEVVEGM
P.patens_163173            IAQVGTISANGDREIGDLLARAMEKVGKEGVITVADGKTLFNELEVVEGM
P.patens_56767             IAQVGTISANGDREIGDLLARAMEKVGKEGVITVSDGKTLFNELEVVEGM
S.lycopersicum_TC192865    IAQVGTISANGERVIGDLIARAMEKVGKEGVITIQDGKTLLNELDVVEGM
L.esculentum_gl_39         IAQVGTISANGERVIGDLIARAMEKVGKEGVITIQDGKTLLNELDVVEGM
S.lycopersicum_TC197855    IAQVGTISANGEREIGEIIARAMEQVGKEGVITIQDGKTLLNDLQVVEGM
A.thaliana_AT3G23990       IAQVGTISANGEREIGELIAKAMEKVGKEGVITIQDGKTLFNELEVVEGM
A.thaliana_AT2G33210       IAQVGTISANGDREIGELIAKAMETVGKEGVITIQDGKTLFNELEVVEGM
O.sativa_Os10g32550.1      IAQVGTISANGEREIGELIAKAMEKVGKEGVITIADGNTLYNELEVVEGM
O.sativa_glomalin_SEQID2   IAQVGTISANGEREIGELIAKAMEKVGKEGVITIADGNTLYNELEVVEGM
O.sativa_glomalin_39       IAQVGTISANGEREIGELIAKAMEKVGKEGVITITDGNTLYNELEVVEGM
O.sativa_Os03g04970.1      IAQVGTISANGEREIGELIAKAMEKVGKEGVITITDGNTLYNELEVVEGM
Z.mays_ZM07MC32795         IAQVGTISANGEREIGELIAKAMEKVGKEGVITIADGNTLYNELEVVEGM
T.aestivum_c54647991       IAQVGTISANGEREIGELIAKAMEKVGKEGVITIADGNTLYNELEVVEGM
A.cepa_CF435092            --------------------------------------------------
P.trichocarpa_sc_I.447     IAQVGTISANGEREIGELIAKAMEKVGKEGVITIQDGKTLSNELEVVEGM
P.trichocarpa_sc_III.1436  IAQVGTISANGEREIGELIAKAMEKVGKEGVITIQDGKTLSNELEVVEGL
M.truncatula_AC161864_24   IAQVGTISANGDREIGELIAKAMEKVGKEGVITIADGKTLQNELEVVEGM
M.truncatula_AC161864_3    IAQVGTISANGDREIGELIAKAMEKVGKEGVITIADGKTLHNELEVVEGM
A.thaliana_AT3G13860.1     ITQVATISANGEREIGELIARAMEKVGKEGVITVADGNTLDNELEVVEGM
P.trichocarpa_sc_44.102    ITLVATISANGEREIGEIMARAMGKAGKHGVITVTDGNTLDNELEVVEGM
S.lycopersicum_TC204816    ITQVGTISANGEREIGEIIARAMEKVGKEGVITVADGNTLDNDLEVVEGM
O.sativa_Os05g46290        INQVATISANGEKEIGDLISKAMEKVGKDGVITITDGKTLDNELEAVQGM
Z.mays_ZM07MC22894         INQVATISANGEKEIGDLISKAMEKVGKDGVITIVDGKTLDNELEAVQGM
```

FIGURE 18 (continued)

```
P.patens_226792              KLDRGYISPYFITNSKTQKVEFENPVILIHEKKINSLQAILPVLELVVKD
P.patens_233067              KLDRGYISPYFITNAKTQKVELENPVILIHEKKINSLQAILPVLELVVRD
P.patens_163173              KLDRGYISPYFITNAKTQKVELENPVILIHEKKINSLQSILPVLELVVKD
P.patens_56767               KLDRGYISPYFITNNKTQKVELENPVILIHEKKITGLQSILPVLELVVRE
S.lycopersicum_TC192865      KLDRGYISPYFITNQKNQKCELDNPLILIHEKKISSINAVVKALELALKR
L.esculentum_gl_39           KLDRGYISPYFITNQKNQKCELDNPLILIHEKKISSINAVVKALELALKR
S.lycopersicum_TC197855      KLDRGYISPYFITNEKNQKCELDDPLILIHEKKISSINAIVKVLELALKR
A.thaliana_AT3G23990         KLDRGYISPYFITNQKTQKCELDDPLILIHEKKISSINSIVKVLELALKR
A.thaliana_AT2G33210         KIDRGYISPYFITNPKTQKCELEDPLILIHEKKISNINAMVKVLELALKK
O.sativa_Os10g32550.1        KLDRGYISPYFVTNPKTQKCELDDPLILIHDKKVSNLHAVVKVLELALKK
O.sativa_glomalin_SEQID2     KLDRGYISPYFVTNPKTQKCELDDPLILIHDKKVSSLHAVVKVLELALKK
O.sativa_glomalin_39         KLDRGYISPYFITNQKNQKCELDDPLTLIHDKKVSNLHAVVKVLELALKK
O.sativa_Os03g04970.1        KLDRGYISPYFITNQKNQKCELDDPLILIHDKKVSNLHAVVKVLELALKK
Z.mays_ZM07MC32795           KLDRGYISPYFITNSKAQKCELEDPLILIHDKKVTNMHAVVKVLEMALKK
T.aestivum_c54647991         KLDRGYISPYFITNQKNQKCELDDPLILIHDKKVSNLRSLVKVLEFALQK
A.cepa_CF435092              --------------------------------------------------
P.trichocarpa_sc_I.447       KLDRGYISPYFITDQKTQKCELDDPLILIHDKKVSSLHAVVKVLELALKR
P.trichocarpa_sc_III.1436    KLDRGYISPYFITDQKTQKCELDDPLILIHDKKVSNLHAVVKVLELALKR
M.truncatula_AC161864_24     KLDRGYISPYFITNQKNQKCELEDPLIIHEKKISNINSIVKVLELALKK
M.truncatula_AC161864_3      KLDRGYISPYFITNQKNQKCELEDPLVIIHEKKISSLNAIVKVLELALKK
A.thaliana_AT3G13860.1       KLARGYISPYFITDEKTQKCELENPIILIHEKKISDINSLLKVLEAAVKS
P.trichocarpa_sc_44.102      KLARGYISPYFITDQKTQK-------------------------------
S.lycopersicum_TC204816      KLGRGYISPYFVTDEKTQKCELENPLILIHDKKISDLNSLVRILELALKR
O.sativa_Os05g46290          KLSRGYISPYFVTDQKTQKCEMENPLILIHDKKISTMNSLLPVLEMSIKN
Z.mays_ZM07MC22894           KLSRGYISPYFVTDQKTQKCEMENPLILIHDKKISNMDSLLPALEISIKN P.patens_226792              QRPLLIVAEDVESEALATLIVNKLRGGVKVCAIKAPGFGENRKSLMQDLA
P.patens_233067              QRPLLIVAEDVESEALATLIVNKLRGGVKVCAIKSPGFGENRKALMQDLA
P.patens_163173              QRPLLIVAEDVESEALATLIVNKLRGG--VKVCAIKAPGFGENRKALMQDLA
P.patens_56767               QRPLLIVAEDVESEALATLIVNKIRGGVKVCAIKAPGFGDSRKSILQDLA
S.lycopersicum_TC192865      QRPLLIVAEDVDNEALATLILNKLRAGIKVCAIKAPGFGENRKAYLQDLA
L.esculentum_gl_39           QRPLLIVAEDVDNEALATLILNKLRAGIKVCAIKAPGFGENRKAYLQDLA
S.lycopersicum_TC197855      QRPLLIVAEDVESEALATLILNKLRAGIKVCAIKAPGFGENRKANLQDLA
A.thaliana_AT3G23990         QRPLLIVSEDVSDALATLILNKLRAGIKVCAIKAPGFGENRKANLQDLA
A.thaliana_AT2G33210         QRPLLIVAEDVESDALATLILNKLRANIKVCAVKAPGFGENRKANLHDLA
O.sativa_Os10g32550.1        QRPLLIVAEDVESEALGTLIINKLRAGIKVCAVKAPGFGENRKANLQDLA
O.sativa_glomalin_SEQID2     QRPLLIVAEDVESEALGTLIINKLRAGIKVCAVKAPGFGENRKANLQDLA
O.sativa_glomalin_39         QRPLLIVAEDVESEALGTLIINKLRAGIKVCAVKAPGFGESRKANLQDLA
O.sativa_Os03g04970.1        QRPLLIVAEDVESEALGTLIINKLRAGIKVCAVKAPGFGESRKANLQDLA
Z.mays_ZM07MC32795           QRPLLIVAEDVESEALGTLIINKLRAGIKVCAVKAPGFGENRKANLQDLA
T.aestivum_c54647991         QRPLLIVAEDLESEALGTLILNKLRGGFKVCAIKAPGFGENRKSNLQDLA
A.cepa_CF435092              --------------------------------------------------
P.trichocarpa_sc_I.447       QRPLLIVAEDVESEALATLILNKLRAGIKVCSIKAPGFGENRKAILQDLA
P.trichocarpa_sc_III.1436    QRPLLIVAEDVESEALATLILNKLRAGIKVCAIKAPGFGENRKATLQDLA
M.truncatula_AC161864_24     QRPLLIVAEDVESDALATLILNKLRAGIKVCAIKAPGFGENRKSGLQDLA
M.truncatula_AC161864_3      QRPLLIVAEDIESDALATLILNKLRAGIKVCAIKAPGFGENRKSGLQDLA
A.thaliana_AT3G13860.1       SRPLLIVAEDVESDALAMLILNKHHGGLKVCAIKAPGFGDNRKASLDDLA
P.trichocarpa_sc_44.102      --------------------------------------------------
S.lycopersicum_TC204816      RSPLLIVAEDVESDALAMLILNKHRAGIKVCAIKAPGFGDNRRANLEDLA
O.sativa_Os05g46290          RRPLLITAEDVEGEALSMLVLNKHRAGLKICAVKAPGFGENRRANLDDVA
Z.mays_ZM07MC22894           RKPLLIVAEDVEGDALSMLVLNKHRAGLKVCAVKAPGFGENRRHNLDDMA
```

FIGURE 18 (continued)

```
P.patens_226792              VLTGGQLITEDMGLKLENITPDMLGHCKKVTVSKDDTIILDGGGNKAILE
P.patens_233067              VLTGGQLISEDLGFKLEKVTPDMLGKCKKVTVSKDDTIILDGGGDKAALE
P.patens_163173              VITGGQLISEDLGFKLEKITPVMLGSSKKVTVSKDDTIILDGGGDKTIIE
P.patens_56767               VLTGGQLISEDLGLKLEKIELDMLGAAKKVTVSKDDTIILDGAGDKAIIE
S.lycopersicum_TC192865      ILTGGQVITEELGLNIENLEFEMLGTSKEATISKDDTVILDGAGEKKSIE
L.esculentum_gl_39           ILTGGQVITEELGLNIENLEFEMLGTSKEATISKDDTVILDGAGEKKSIE
S.lycopersicum_TC197855      ALTGGQVITEELGMNIENVELEMLGKCKKVTISKDDTVVLDGAGEKKAIE
A.thaliana_AT3G23990         ALTGGEVITDELGMNLEKVDLSMLGTCKKVTVSKDDTVILDGAGDKKGIE
A.thaliana_AT2G33210         ALTGAQVITEELGMNLDNIDLSMFGNCKKVTVSKDDTVVLDGAGDKQAIG
O.sativa_Os10g32550.1        ILTGGEVITEELGMNLEKFEPQMLGTCKKVTVSKDDTVILDGAGDKKSIE
O.sativa_glomalin_SEQID2     ILTGGEVITEELGMNLEKFEPQMLGTCKKVTVSKDDTVILDGAGDKKSIE
O.sativa_glomalin_39         ILTGGEVITEELGMNLENFEPQMLGTCKKVTVSKDDTVILDGAGDKKAIE
O.sativa_Os03g04970.1        ILTGGEVITEELGMNLENFEPQMLGTCKKVTVSKDDTVILDGAGDKKAIE
Z.mays_ZM07MC32795           ILTGGEVITEELGMNLENVEPHMLGSCKKVTVSKDDTVILDGAGDKKSIE
T.aestivum_c54647991         ILTGGEVITEELGMNLENFEPNMLGTCKKVTISKDDTVILDGAGDKKAIE
A.cepa_CF435092              --------------------------------------------------
P.trichocarpa_sc_I.447       ALTGGEQVLNFCFAGYN---------------------------------
P.trichocarpa_sc_III.1436    VLTGAEVITEELGLNLEKVDLDMLGSCKKVTVSKDDTVILDGAGDKKSIE
M.truncatula_AC161864_24     VLTGGQLITEELGMNLEKVDLEMFGSCKKITISKDDTVILDGAGDKKSIE
M.truncatula_AC161864_3      VLTGGQLITEDLGHNLEKVDLEMFGSCKKITISKDDTVILDGAGDKKAIE
A.thaliana_AT3G13860.1       VLTGAEVISEERGLSLEKIRPELLGTAKKVTVTRDDTIILHGGGDKKLIE
P.trichocarpa_sc_44.102      --------------------------------------------------
S.lycopersicum_TC204816      VLTGGEVISEERGLDLSKVQFDMLGTAKKVTVSLDDTLVLHGGGDKKLIE
O.sativa_Os05g46290          VLTGGEVVSEDQGLDLGKVELQMLGTAKKVTVSLDDTIILDGGGDKQQIE
Z.mays_ZM07MC22894           VMTGGEVISEERGLDLGKVQLQMLGTAKKVTVSLDDTIILDGGGDKQQID P.patens_226792              DRTEQIREAISTATSDYDKEKLQERLAKLSGGVAVLKIGGASEVEVSEKK
P.patens_233067              ERTEQIREAISAATSDYDKEKLQERLAKLSGGVAVLKIGGASEVEVNEKK
P.patens_163173              DRIETIREAINSATSDYDKEKLQERLAKLSGGVAVLKIGGASEVEVSEKK
P.patens_56767               ERLEQIRDSLGQTTSEYDKEKLEERLAKLSGGVAVLKIGGTSEVEVNEKK
S.lycopersicum_TC192865      ERCELIRSTIEQSTSDYDKEKLQERLAKLSGGVAVLKIGGASEAEVGEKK
L.esculentum_gl_39           ERCELIRSTIEQSTSDYDKEKLQERLAKLSGGVAVLKIGGASEAEVGEKK
S.lycopersicum_TC197855      ERCEQIRSAIELSTSDYDKEKLQERLARLSGGVAVLKVGGASEVEVGEKK
A.thaliana_AT3G23990         ERCEQIRSAIELSTSDYDKEKLQERLAKLSGGVAVLKIGGASEAEVGEKK
A.thaliana_AT2G33210         ERCEQIRSMVEASTSDYDKEKLQERLAKLSGGVAVLKIGGASETEVSEKK
O.sativa_Os10g32550.1        ERAEQIRSAIELSTSDYDKEKLQERLAKLSGGVAVLKIGGASEAEVGEKK
O.sativa_glomalin_SEQID2     ERAEQIRSAIELSTSDYDKEKLQERLAKLSGGVAVLKIGGASEAEVGEKK
O.sativa_glomalin_39         ERAEQLRSAIELSTSDYDKEKLQERLAKLSGGVAVLKIGGASEAEVGEKK
O.sativa_Os03g04970.1        ERAEQLRSAIELSTSDYDKEKLQERLAKLSGGVAVLKIGGASEAEVGEKK
Z.mays_ZM07MC32795           ERADQIRSAVENSTSDYDKEKLQERLAKLSGGVAVLKIGGASEAEVGEKK
T.aestivum_c54647991         ERAELLTSSIEQCTSDYDKEKIQERLAKLSGGVAVLKIGGASEAEVGEKK
A.cepa_CF435092              --------------------------------------------------
P.trichocarpa_sc_I.447       --------------------------------------------------
P.trichocarpa_sc_III.1436    ERCEQIRSAVESSTSDYDKEKLHERLAKLSGGVAVLKIGGASEAEVGEKK
M.truncatula_AC161864_24     ERCEQIRSAVENSTSDYDKEKLQERLAKLSGGVAVLKIGGASEAEVGEKK
M.truncatula_AC161864_3      ERCEQIRSAVENSTSDYDRDKLQERLAKLSGGVAVLKIGGASEAEVGEKK
A.thaliana_AT3G13860.1       ERCEELRSANEKSTSTFDQEKTQERLSKLSGGVAVFKVGGASESEVGERK
P.trichocarpa_sc_44.102      --------------------------------------------------
S.lycopersicum_TC204816      ERCEQLRIAKEKSSAMFDKEKAQERLSKLSGGVAVFKVGGASEAEVGERK
O.sativa_Os05g46290          ERCQQLRESMDKSTAVFDKEKAQERLSKLSGGVAVLKIGGASEVEVGEKK
```

FIGURE 18 (continued)

```
P.patens_226792              DRVTDALNATKAAVEEGIVPGGGVALLYASRELDNVQTSNFDQKVGVQII
P.patens_233067              DRVTDALNATKAAVEEGIVPGGGVALLYASRELEKVQTANFDQKIGVQII
P.patens_163173              DRVTDALNATKAAVEEGIVPGGGVALLYASRELDKIQTANFDQKVGVQII
P.patens_56767               DRVTDALNATKAAVEEGIVPGGGVALLYASKELYKIPTNNFDQRIGVQII
S.lycopersicum_TC192865      DRVTDALNATKAAVEEGIVPGGGVALLYAARELDNLTTANFDQKIGVQII
L.esculentum_gl_39           DRVTDALNATKAAVEEGIVPGGGVALLYAARELDNLTAANFDQKIGVQII
S.lycopersicum_TC197855      DRVTDALNATKAAVEEGILPGGGVALLYASKELDSLPTANFDQKIGVQII
A.thaliana_AT3G23990         DRVTDALNATKAAVEEGILPGGGVALLYAARELEKLPTANFDQKIGVQII
A.thaliana_AT2G33210         DRVTDALNATKAAVEEGIVPGGGVALLYASKELEKLSTANFDQKIGVQII
O.sativa_Os10g32550.1        DRVTDALNATKAAVEEGIVPGGGVALLYASKELDKLPTANFDQKIGVQII
O.sativa_glomalin_SEQID2     DRVTDALNATKAAVEEGIVPGGGVALLYASKELDKLPTANFDQKIGVQII
O.sativa_glomalin_39         DRVTDALNATKAAVEEGIVPGGGVALLYASKDLDKLQTANFDQKIGVQII
O.sativa_Os03g04970.1        DRVTDALNATKAAVEEGIVPGGGVALLYASKDLDKLQTANFDQKIGVQII
Z.mays_ZM07MC32795           DRVTDALNATKAAVEEGIVPGGGVALLYASKELDKLQTANFDQKIGVQII
T.aestivum_c54647991         DRVTDALNATKAAVEEGIVPGGGVALLYASKDLDKLPTANFDQKIGVQII
A.cepa_CF435092              --------------------------------------------------
P.trichocarpa_sc_I.447       --------------------------------------------------
P.trichocarpa_sc_III.1436    DRVTDALNATKAAVEEGIVPGGGAALLYASKELDKLQTANFDQKIGVQII
M.truncatula_AC161864_24     DRVTDALNATKAAVEEGIVPGGGVALLYASNELSKLPTANFDQKIGVQII
M.truncatula_AC161864_3      DRVTDALNATKAAVEEGIVPGGGVALLYASNELSKLSTANFDQKIGVQII
A.thaliana_AT3G13860.1       DRVTDALNATRAAVEEGIIPGGGVALLYATKALDNLQTENEDQRRGVQIV
P.trichocarpa_sc_44.102      --------------------------------------------------
S.lycopersicum_TC204816      DRVTDALNATRAAVEEGIVPGGGVALLYATKCLKGLQTANDGQKRGVEII
O.sativa_Os05g46290          DRVTDALHAARAAVEEGIVPGGGVALLYATKELDKIITANEDEKIGVQII
Z.mays_ZM07MC22894           DRVTDALNAARAAVEEGIVPGGGVALLYATKELDKISTANEDEKIGVQII P.patens_226792              QNALKMPAYTIARNAGVEGAVVVGKLLEEANLNIGYDAAKAEYVDMVKAG
P.patens_233067              QNALRMPAYTIARNAGVEGAVVVGKLMEQTNMSIGYDAAKAEYVDMVKAG
P.patens_163173              QNALKMPAYTIAQNAGVEGAVVVGKLLEQTNMSIGYDAAKAEYVDMVKAG
P.patens_56767               QNALKMPAYTIAHNAGLEGAVVVGKLLDQSNLNIGYDAAKGEYVDMVKAG
S.lycopersicum_TC192865      QNALKTPVHTIASNAGVEGAVVVGKLLDQDNLDLGYDAAKGEYVDMIKAG
L.esculentum_gl_39           QNALKTPVHTIASNAGVEGAVVVGKLLDQDNLDLGYDAAKGEYVDMIKAG
S.lycopersicum_TC197855      QNALKTPVYTIASNAGVEGSVVVGKLLEQDNPDLGYDAAKGEYVDMVKAG
A.thaliana_AT3G23990         QNALKTPVYTIASNAGVEGAVIVGKLLEQDNPDLGYDAAKGEYVDMVKAG
A.thaliana_AT2G33210         QNALKTPVYTIASNAGVEGAVVVGKLLEQDNPDLGYDAAKGEYVDMIKAG
O.sativa_Os10g32550.1        QNALKTPVHTIASNAGVEGAVVVGKLLEQDNTDLGYDAAKGEYVDMVKAG
O.sativa_glomalin_SEQID2     QNALKTPVHTIASNAGVEGAVVVGKLLEQDNTDLGYDAAKGEYVDMVKAG
O.sativa_glomalin_39         QNALKTPVHTIASNAGVEGSVIIGKLLEQDNTDLGYDAAKGEYVDMVKSG
O.sativa_Os03g04970.1        QNALKTPVHTIASNAGVEGSVIIGKLLEQDNTDLGYDAAKGEYVDMVKSG
Z.mays_ZM07MC32795           QNALKTPVHTIASNAGVEGAVVVGKLLEQGNTDLGYDAAKDEYVDMVKAG
T.aestivum_c54647991         QNALKTPVHTIATNAGVEGAVIVGKLLEQHNTDLGYDAAKGEYVDMVKAG
A.cepa_CF435092              --------------------------------------------------
P.trichocarpa_sc_I.447       --------------------------------------------------
P.trichocarpa_sc_III.1436    QNALKTPVHTIATNAGVEGAVVVGKLLEQDNPDLGYDAAKDEYVDMVKAG
M.truncatula_AC161864_24     QNALKTPVHTIASNAGVEGAVVVGKLLEQDNPDLGYDAAKGEYVDMVKSG
M.truncatula_AC161864_3      QNALKTPVHTIASNAGVEGAVVVGKLLEQDNPDLGYDAAKGEYVDMVKAG
A.thaliana_AT3G13860.1       QNALKAPAFTIAANAGYDGSLVVGKLLEQDDCNFGFDAAKGKYVDMVKAG
P.trichocarpa_sc_44.102      --------------------------------------------------
S.lycopersicum_TC204816      ENALKAPTFTIASNAGADGALVVGKLLEQDDLNLGCDAAKGTYLHMVKAG
O.sativa_Os05g46290          KNALKAPLMTIAANAGIDGGVVIGKLIEQDNLNMGYDAARGEYVDMIKAG
Z.mays_ZM07MC22894           KNSLKAPLMTIAANAGIDGAIVIGKLIEQEDLSLGYDAAKGEYVDMIKAG
```

FIGURE 18 (continued)

```
P.patens_226792           IIDPVKVIRTALVDAASVASLLTTTEAIVADFPKDD--EAMPGMGG-MGG
P.patens_233067           IIDPVKVIRTALVDAASVASLMTTTEAVIADFPKDDK-EAMPGMGGGMGG
P.patens_163173           IIDPVKVIRTSLVDAASVASLMTTTESVVADFNKAEDKEMMGGMGG---G
P.patens_56767            IIDPVKVIRTAFVDAASVASLMTTTEAVVAESNKEEK-DLVPSTGGGISG
S.lycopersicum_TC192865   IIDPVKVIRTALVDAASVSSLLTTTEAVVELPKDEK-ESPAMGGGMGGG
L.esculentum_gl_39        IIDPVKVIRTALVDAASVSSLLTTTEAVVELPKDEK-ESPAMGGGMGGG
S.lycopersicum_TC197855   .IIDPLKVIRTALVDAASVSSLLTTTEAIVELPKDEK-AAPAMPG-----
A.thaliana_AT3G23990      IIDPLKVIRTALVDAASVSSLLTTTEAVVDLPKDES-ESGAAGAGMGG-
A.thaliana_AT2G33210      IIDPLKVIRTALVDAASVSSLLTTTEAVVTEIPTKEV-ASPGMGGGGMGG
O.sativa_Os10g32550.1     IIDPLKVIRTALVDAASVSSLMTTTESIIVEIPKEE----KEAPAMGG--
O.sativa_glomalin_SEQID2  IIDPLKVIRTALVDAASVSSLMTTTESIIVEIPKEE----KEAPAMGG--
O.sativa_glomalin_39      IIDPLKVIRTALVDAASVSSLMTTTESIIVEIPKEEE-AAAAAPAMGG--
O.sativa_Os03g04970.1     IIDPLKVIRTALVDAASVSSLMTTTESIIVEIPKEEE-AAAAAPAMGG--
Z.mays_ZM07MC32795        IIDPLKVIRTALVDAASVSSLMTTTESIIVEIPKEE----APAPAMGG--
T.aestivum_c54647991      IIDPLKVIRTALVDAASVSSLMTTTEAIIVEIPKED----KAAPAMGGGG
A.cepa_CF435092           --------------------------------------------------
P.trichocarpa_sc_I.447    --------------------------------------------------
P.trichocarpa_sc_III.1436 IIDPLKVIRTALVDAASVSSLMTTTEAVITELPKDE----NDAPAMGPG-
M.truncatula_AC161864_24  IIDPLKVIRTALVDAASVSSLMTTTEAVVSELPKED----KDTPAMPG--
M.truncatula_AC161864_3   IIDPLKVIRTALVDAASVSSLMTTTEAIVSDLPSED----KDGPAMPAG-
A.thaliana_AT3G13860.1    IIDPVKVIRTALTDAASVSLLLTTTEASVLVKADEN-------TPNHVPD
P.trichocarpa_sc_44.102   --------------------------------------------------
S.lycopersicum_TC204816   IIDPVKVVRTALMDAASVSLLLTTAEAAIVDRQGEEN-----PLANRMPN
O.sativa_Os05g46290       IIDPVKVIRTALQDASSVSLLMTTTEAAVAEPPAAKA----RMASRMPQ
Z.mays_ZM07MC22894        IIDPVKVIRTALQDAASVSLLMATTEAAVSELPATKS----RIASRMPQ P.patens_226792           MGGMGGMY----
P.patens_233067           MGGMGGMY----
P.patens_163173           MGGMGGMY----
P.patens_56767            LGGMGGMYG---
S.lycopersicum_TC192865   MGGMDF------
L.esculentum_gl_39        MGGMDF------
S.lycopersicum_TC197855   -GGMDY------
A.thaliana_AT3G23990      MGGMDY------
A.thaliana_AT2G33210      MGGMGGMGGMGF
O.sativa_Os10g32550.1     MGGMDY------
O.sativa_glomalin_SEQID2  MGGMDY------
O.sativa_glomalin_39      MGGMGF------
O.sativa_Os03g04970.1     MGGMGF------
Z.mays_ZM07MC32795        MGGMDY------
T.aestivum_c54647991      MGGMDF------
A.cepa_CF435092           ------------
P.trichocarpa_sc_I.447    ------------
P.trichocarpa_sc_III.1436 -MGMDY------
M.truncatula_AC161864_24  MGGMD-Y-----
M.truncatula_AC161864_3   MGGMGGY-----
A.thaliana_AT3G13860.1    MASMGM------
P.trichocarpa_sc_44.102   ------------
S.lycopersicum_TC204816   MGGMY-------
O.sativa_Os05g46290       MSGMDF------
Z.mays_ZM07MC22894        MSGMDF------
```

FIGURE 18 (continued)

PLANTS HAVING ENHANCED YIELD-RELATED TRAITS AND A METHOD FOR MAKING THE SAME

RELATED APPLICATIONS

This application is a national stage application (under 35 U.S.C. §371) of PCT/EP2010/058129, filed Jun. 10, 2010; which claims benefit of European Application No. 09163277.8, filed Jun. 19, 2009; European Application No. 09163257.0, filed Jun. 19, 2009; European Application No. 09163287.7, filed Jun. 19, 2009; U.S. Provisional Application No. 61/223,431, filed Jul. 7, 2009; U.S. Provisional Application Ser. No. 61/223,429, filed Jul. 7, 2009; U.S. Provisional Application Ser. No. 61/223,389, filed Jul. 7, 2009; European Application No. 09165779.1, filed Jul. 17, 2009; U.S. Provisional Application Ser. No. 61/226,307, filed Jul. 17, 2009; U.S. Provisional Application Ser. No. 61/227,448, filed Jul. 22, 2009; European Application No. 09166083.7, filed Jul. 22, 2009; U.S. Provisional Application Ser. No. 61/227,803, filed Jul. 23, 2009; and European Application No. 09166200.7, filed Jul. 23, 2009.

SUBMISSION OF SEQUENCE LISTING

The Sequence Listing associated with this application is filed in electronic format via EFS-Web and hereby incorporated by reference into the specification in its entirety. The name of the text filed containing the Sequence Listing is Revised _Sequence _List _13987 _00160 _US. The size of the text file is 1,182 KB and the text file was created on Feb. 1, 2012.

The present invention relates generally to the field of molecular biology and concerns a method for enhancing yield related traits by modulating expression in a plant of a nucleic acid encoding an eRF1 polypeptide. The present invention also concerns plants having modulated expression of a nucleic acid encoding this eRF1 polypeptide, which plants have enhanced yield-related traits relative to corresponding wild type plants or other control plants. The invention also provides constructs useful in the methods of the invention.

The present invention relates generally to the field of molecular biology and concerns a method for enhancing various economically important yield-related traits in plants. More specifically, the present invention concerns a method for enhancing yield-related traits in plants by modulating expression in a plant of a nucleic acid encoding an SCAMP-like (secretory carrier membrane proteins) polypeptide. The present invention also concerns plants having modulated expression of a nucleic acid encoding an SCAMP-like polypeptide, which plants have enhanced yield-related traits relative to control plants. The invention also provides hitherto unknown SCAMP-like-encoding nucleic acids, and constructs comprising the same, useful in performing the methods of the invention.

The present invention relates generally to the field of molecular biology and concerns a method for enhancing various yield-related traits in plants by modulating expression in a plastid of a plant of a nucleic acid encoding a fibrillin polypeptide. The present invention also concerns plants having modulated expression in a plastid of a plant of a nucleic acid encoding a fibrillin, which plants have enhanced yield-related traits relative to corresponding wild type plants or other control plants. The invention also provides constructs useful in the methods of the invention.

The present invention relates generally to the field of molecular biology and concerns a method for improving various plant growth characteristics by modulating expression in a plant of a nucleic acid encoding a PLATZ (plant AT-rich sequence- and zinc binding protein) polypeptide. The present invention also concerns plants having modulated expression of a nucleic acid encoding a PLATZ polypeptide, which plants have improved growth characteristics relative to corresponding wild type plants or other control plants. The invention also provides constructs useful in the methods of the invention.

The present invention relates generally to the field of molecular biology and concerns a method for enhancing yield related traits by modulating expression in a plant of a nucleic acid encoding a PLST-like polypeptide. The present invention also concerns plants having modulated expression of a nucleic acid encoding a PLST-like polypeptide, which plants have enhanced yield-related traits relative to corresponding wild type plants or other control plants. The invention also provides constructs useful in the methods of the invention.

The present invention relates generally to the field of molecular biology and concerns a method for enhancing yield-related traits in plants by modulating expression in a plant of a nucleic acid encoding a Glomalin (HSP60, chaperonin CNP60) polypeptide. The present invention also concerns plants having modulated expression of a nucleic acid encoding a Glomalin polypeptide, which plants have enhanced yield-related traits relative to corresponding wild type plants or other control plants. The invention also provides constructs useful in the methods of the invention.

The ever-increasing world population and the dwindling supply of arable land available for agriculture fuels research towards increasing the efficiency of agriculture. Conventional means for crop and horticultural improvements utilise selective breeding techniques to identify plants having desirable characteristics. However, such selective breeding techniques have several drawbacks, namely that these techniques are typically labour intensive and result in plants that often contain heterogeneous genetic components that may not always result in the desirable trait being passed on from parent plants. Advances in molecular biology have allowed mankind to modify the germplasm of animals and plants. Genetic engineering of plants entails the isolation and manipulation of genetic material (typically in the form of DNA or RNA) and the subsequent introduction of that genetic material into a plant. Such technology has the capacity to deliver crops or plants having various improved economic, agronomic or horticultural traits.

A trait of particular economic interest is enhanced yield characteristics. Yield is normally defined as the measurable produce of economic value from a crop. This may be defined in terms of quantity and/or quality. Yield is directly dependent on several factors, for example, the number and size of the organs, plant architecture (for example, the number of branches), seed production, leaf senescence and more. Root development, nutrient uptake, stress tolerance and early vigour may also be important factors in determining yield. Optimizing the abovementioned factors may therefore contribute to increasing crop yield.

Seed yield is a particularly important trait, since the seeds of many plants are important for human and animal nutrition. Crops such as corn, rice, wheat, canola and soybean account for over half the total human caloric intake, whether through direct consumption of the seeds themselves or through consumption of meat products raised on processed seeds. They are also a source of sugars, oils and many kinds of metabolites used in industrial processes. Seeds contain an embryo (the source of new shoots and roots) and an endosperm (the source of nutrients for embryo growth during germination and during early growth of seedlings). The development of a seed involves many genes, and requires the transfer of metabolites from roots, leaves and stems into the growing seed. The endosperm, in particular, assimilates the metabolic precursors of carbohydrates, oils and proteins and synthesizes them into storage macromolecules to fill out the grain.

Plant biomass is yield for forage crops like alfalfa, silage corn and hay. Many proxies for yield have been used in grain crops. Chief amongst these are estimates of plant size. Plant size can be measured in many ways depending on species and developmental stage, but include total plant dry weight, above-ground dry weight, above-ground fresh weight, leaf area, stem volume, plant height, rosette diameter, leaf length, root length, root mass, tiller number and leaf number. Many species maintain a conservative ratio between the size of different parts of the plant at a given developmental stage. These allometric relationships are used to extrapolate from one of these measures of size to another (e.g. Tittonell et al 2005 Agric Ecosys & Environ 105: 213). Plant size at an early developmental stage will typically correlate with plant size later in development. A larger plant with a greater leaf area can typically absorb more light and carbon dioxide than a smaller plant and therefore will likely gain a greater weight during the same period (Fasoula & Tollenaar 2005 Maydica 50:39). This is in addition to the potential continuation of the micro-environmental or genetic advantage that the plant had to achieve the larger size initially. There is a strong genetic component to plant size and growth rate (e.g. ter Steege et al 2005 Plant Physiology 139:1078), and so for a range of diverse genotypes plant size under one environmental condition is likely to correlate with size under another (Hittalmani et al 2003 Theoretical Applied Genetics 107:679). In this way a standard environment is used as a proxy for the diverse and dynamic environments encountered at different locations and times by crops in the field.

Another important trait for many crops is early vigour. Improving early vigour is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. The ability to engineer early vigour into plants would be of great importance in agriculture. For example, poor early vigour has been a limitation to the introduction of maize (*Zea mays* L.) hybrids based on Corn Belt germplasm in the European Atlantic.

Harvest index, the ratio of seed yield to aboveground dry weight, is relatively stable under many environmental conditions and so a robust correlation between plant size and grain yield can often be obtained (e.g. Rebetzke et al 2002 Crop Science 42:739). These processes are intrinsically linked because the majority of grain biomass is dependent on current or stored photosynthetic productivity by the leaves and stem of the plant (Gardener et al 1985 Physiology of Crop Plants. Iowa State University Press, pp 68-73). Therefore, selecting for plant size, even at early stages of development, has been used as an indicator for future potential yield (e.g. Tittonell et al 2005 Agric Ecosys & Environ 105: 213). When testing for the impact of genetic differences on stress tolerance, the ability to standardize soil properties, temperature, water and nutrient availability and light intensity is an intrinsic advantage of greenhouse or plant growth chamber environments compared to the field. However, artificial limitations on yield due to poor pollination due to the absence of wind or insects, or insufficient space for mature root or canopy growth, can restrict the use of these controlled environments for testing yield differences. Therefore, measurements of plant size in early development, under standardized conditions in a growth chamber or greenhouse, are standard practices to provide indication of potential genetic yield advantages.

A further important trait is that of improved abiotic stress tolerance. Abiotic stress is a primary cause of crop loss worldwide, reducing average yields for most major crop plants by more than 50% (Wang et al., Planta (2003) 218: 1-14). Abiotic stresses may be caused by drought, salinity, extremes of temperature, chemical toxicity, excess or deficiency of nutrients (macroelements and/or microelements), radiation and oxidative stress. The ability to improve plant tolerance to abiotic stress, namely to drought, would be of great economic advantage to farmers worldwide and would allow for the cultivation of crops during adverse conditions and in territories where cultivation of crops may not otherwise be possible.

Crop yield may therefore be enhanced by optimising one of the above-mentioned factors.

Depending on the end use, the modification of certain yield traits may be favoured over others. For example for applications such as forage or wood production, or bio-fuel resource, an increase in the vegetative parts of a plant may be desirable, and for applications such as flour, starch or oil production, an increase in seed parameters may be particularly desirable. Even amongst the seed parameters, some may be favoured over others, depending on the application. Various mechanisms may contribute to increasing seed yield, whether that is in the form of increased seed size or increased seed number.

It has now been found that various yield related traits may be enhanced in plants by modulating expression in a plant of a nucleic acid encoding an eRF1 protein-like in a plant.

It has also now been found that various growth characteristics may be improved in plants by modulating expression in a plant of a nucleic acid encoding a SCAMP-like in a plant.

It has also now been found that various yield-related traits may be improved in plants by modulating expression of a nucleic acid encoding a fibrillin polypeptide in a plant plastid.

It has also now been found that various growth characteristics may be improved in plants by modulating expression in a plant of a nucleic acid encoding a PLATZ (plant AT-rich sequence- and zinc binding protein) in a plant.

It has also now been found that various yield related traits may be enhanced in plants by modulating expression in a plant of a nucleic acid encoding a PLST-like protein in a plant.

It has also now been found that various yield-related traits may be improved in plants by modulating expression in a plant of a nucleic acid encoding a Glomalin (HSP60, chaperonin CNP60) polypeptide in a plant.

BACKGROUND

1. SCAMP-Like Polypeptides

Considerable evidence for endocytosis in plants has accumulated during recent years (Samaj et al., 2004; Plant Physiol. 135: 1150-1161). Some of the components of the clathrin-based internalization machinery have been identified and data for the uptake of cell surface receptor-ligand complexes is accumulating (Russinova et al. 2004, Plant Cell 16: 3216-3229). Recently it has been hypothesized that plant SCAMP proteins might play a role in mediating endocytosis in plant cells (Lam et al. 2007; The Plant Cell, Vol. 19: 296-319). SCAMP proteins were Initially identified as secretory vesicle components in mammalian exocrine glands and later found to be ubiquitous proteins in eukaryotes (Fernandez-Chacon and Sudhof, 2000; J. Neurosci. 20: 7941-7950). SCAMPs were found in both the trans-Golgi and the endosomal recycling compartment, and they appear to be concentrated within the motile population of early and recycling endosomes (Castle and Castle, 2005) J. Cell Sci. 118: 3769-3780. Plant SCAMP homologs have been found amongst others in rice (*Oryza sativa*), *Arabidopsis*, and pea (*Pisum sativum*) and are thought to be present in many other plant species (Fernandez-Chacon and Sudhof, 2000). In plants SCAMPs have been localized at the plasma memebrane and the and mobile cytosolic organelles (Lam et al. 2007).

2. Fibrillin Polypeptides

The most prominent proteins in plastoglobulins (PGs) are fibrillins. Fibrillins are plastid-associated lipid-binding proteins that are ubiquitous in plants and cyanobacteria. They have been primarily characterized from chromoplasts of tomato and pepper fruits and are known to accumulate during abiotic stress in plastids e.g., inflicted by high light, cold, and drought, and also during pathogen infection. The family of fibrillin-like proteins contain a hydrophobic domain that associates with or anchors within lipids. Fibrillins associate with stromal lamellae of thylakoids and fibrillic carotenoid-containing structures of chromoplasts. A model for the fibrillic structures predicts a layer of fibrillin shielding polar lipids and carotenoids. Furthermore, fibrillin is known to accumulate during high-light conditions, and fibrillin affects photosynthetic efficiency (see Yang et al., Proc Natl Acad Sci USA. 2006 April 11; 103(15): 6061-6066). Evidence is also available for the association of these proteins to various lipid globules under non-stressed conditions preventing plastoglobule coalescence (see CAB Abstracts, Simkin et al., Recent Research Developments in Biochemistry, 2004).

The *Arabidopsis* genome has 13 fibrillin genes that are all predicted to encode plastid localized proteins (Laizet et al., 2004). Rey et al., (Plant J. 2000 March; 21(5):483-94) disclose transgenic *Nicotiana tabacum* plants over-expressing fibrillin using a constitutive promoter. No growth difference between wild-type plants and transgenic plants was noticed under low light conditions, however transgenic plants were reported to exhibit a longer main stem, enhanced development of lateral stems and accelerated floral development under higher light intensities.

3. PLATZ Polypeptides

PLATZ proteins form a plant specific family of DNA-binding proteins. So far, only one member has been described in more detail (PLATZ1, Nagano et al, Nucl. Acids Res. 29, 4097-4105, 2001). Sequence comparison between PLATZ1 and other putative PLATZ proteins revealed the presence of two Zn-binding domains with conserved cysteine and histidine residues. DNA-binding activity required the presence of Zn. PLATZ1 was shown to bind A/T-rich regions in a non-specific way, and was able to induce expression of the GTPase pra2 and plastocyanin petE genes (Nagano et al., 2001). Though DNA-binding proteins are implicated in DNA replication and in regulation of gene expression, a precise characterisation of the role of PLATZ proteins is still lacking.

4. Glomalin Polypeptides

Glomalin was first identified as a high molecular mass glycoprotein produced by the arbuscular mycorrhizal fungi (like *Glomus* sp). It is secreted into the environment and the sugar moiety was postulated to play a role in sequestering of Cu and Zn in the soil. Gadkar and Rillig (FEMS Microbiol Lett. 263, 93-101, 2006) have shown that the glomalin of *Glomus intraradices* is a protein of 590 amino acids with three N-terminal glycosylation sites and a string of GGM motifs at the C-terminal end. The genomic sequence had three introns of 67, 76 and 131 bp length. The protein had homology to heat shock protein 60 (hsp 60); a plant homologue of hsp60 reportedly plays a role in acclimating photosynthesis to heat stress, possibly by protecting Rubisco activase from thermal denaturation (Salvucci M., E., J Exp Bot. 2008; 59(7):1923-33). However, the precise role of glomalin orthologues in plant biology remains to be elucidated.

SUMMARY 1. eRF1 Polypeptides

Surprisingly, it has now been found that modulating expression of a nucleic acid encoding an eRF1 polypeptide gives plants having enhanced yield-related traits, in particular enhanced yield relative to control plants.

According one embodiment, there is provided a method for enhanced yield related traits of a plant relative to control plants, comprising modulating expression of a nucleic acid encoding an eRF1 polypeptide in a plant.

2. SCAMP-Like Polypeptides

Surprisingly, it has now been found that modulating expression of a nucleic acid encoding a SCAMP-like polypeptide gives plants having enhanced yield-related traits relative to control plants.

According one embodiment, there is provided a method for enhancing yield-related traits of a plant relative to control plants, comprising modulating expression of a nucleic acid encoding a SCAMP-like polypeptide in a plant.

3. Fibrillin Polypeptides

Surprisingly, it has now been found that modulating expression in a plastid of a plant of a nucleic acid encoding a fibrillin polypeptide gives plants having enhanced yield-related traits relative to control plants.

According one embodiment, there is provided a method for enhancing yield-related traits relative to control plants, comprising modulating expression in a plant plastid of a nucleic acid encoding a fibrillin polypeptide.

4. PLATZ Polypeptides

Surprisingly, it has now been found that modulating expression of a nucleic acid encoding a PLATZ polypeptide gives plants having enhanced yield-related traits, in particular increased yield relative to control plants.

According one embodiment, there is provided a method for improving yield related traits of a plant relative to control plants, comprising modulating expression of a nucleic acid encoding a PLATZ polypeptide in a plant.

5. PLST-Like Polypeptides

Surprisingly, it has now been found that modulating expression of a nucleic acid encoding a PLST-like polypeptide gives plants having enhanced yield-related traits, in particular enhanced yield relative to control plants.

According one embodiment, there is provided a method for enhanced yield related traits of a plant relative to control plants, comprising modulating expression of a nucleic acid encoding a PLST-like polypeptide in a plant.

6. Glomalin Polypeptides

Surprisingly, it has now been found that modulating expression of a nucleic acid encoding a Glomalin polypeptide gives plants having enhanced yield-related traits, in particular increased seed yield relative to control plants.

According one embodiment, there is provided a method for improving yield-related traits in plants relative to control plants, comprising modulating expression in a plant of a nucleic acid encoding a Glomalin polypeptide.

DEFINITIONS

The following definitions will be used throughout the present specification.

Polypeptide(s)/Protein(s)

The terms "polypeptide" and "protein" are used interchangeably herein and refer to amino acids in a polymeric form of any length, linked together by peptide bonds.

Polynucleotide(s)/Nucleic Acid(s)/Nucleic Acid Sequence(s)/Nucleotide Sequence(s)

The terms "polynucleotide(s)", "nucleic acid sequence(s)", "nucleotide sequence(s)", "nucleic acid(s)", "nucleic acid molecule" are used interchangeably herein and refer to nucleotides, either ribonucleotides or deoxyribonucleotides or a combination of both, in a polymeric unbranched form of any length.

Homologue(s)

"Homologues" of a protein encompass peptides, oligopeptides, polypeptides, proteins and enzymes having amino acid substitutions, deletions and/or insertions relative to the unmodified protein in question and having similar biological and functional activity as the unmodified protein from which they are derived.

A deletion refers to removal of one or more amino acids from a protein.

An insertion refers to one or more amino acid residues being introduced into a predetermined site in a protein. Insertions may comprise N-terminal and/or C-terminal fusions as well as intra-sequence insertions of single or multiple amino acids. Generally, insertions within the amino acid sequence will be smaller than N- or C-terminal fusions, of the order of about 1 to 10 residues. Examples of N- or C-terminal fusion proteins or peptides include the binding domain or activation domain of a transcriptional activator as used in the yeast two-hybrid system, phage coat proteins, (histidine)-6-tag, glutathione S-transferase-tag, protein A, maltose-binding protein, dihydrofolate reductase, Tag•100 epitope, c-myc epitope, FLAG®-epitope, lacZ, CMP (calmodulin-binding peptide), HA epitope, protein C epitope and VSV epitope.

A substitution refers to replacement of amino acids of the protein with other amino acids having similar properties (such as similar hydrophobicity, hydrophilicity, antigenicity, propensity to form or break α-helical structures or β-sheet structures). Amino acid substitutions are typically of single residues, but may be clustered depending upon functional constraints placed upon the polypeptide and may range from 1 to 10 amino acids; insertions will usually be of the order of about 1 to 10 amino acid residues. The amino acid substitutions are preferably conservative amino acid substitutions. Conservative substitution tables are well known in the art (see for example Creighton (1984) Proteins. W.H. Freeman and Company (Eds) and Table 1 below).

TABLE 1

Examples of conserved amino acid substitutions

| Residue | Conservative Substitutions |
|---------|---------------------------|
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Ser | Thr; Gly |
| Thr | Ser; Val |
| Trp | Tyr |
| Tyr | Trp; Phe |
| Val | Ile; Leu |

Amino acid substitutions, deletions and/or insertions may readily be made using peptide synthetic techniques well known in the art, such as solid phase peptide synthesis and the like, or by recombinant DNA manipulation. Methods for the manipulation of DNA sequences to produce substitution, insertion or deletion variants of a protein are well known in the art. For example, techniques for making substitution mutations at predetermined sites in DNA are well known to those skilled in the art and include M13 mutagenesis, T7-Gen in vitro mutagenesis (USB, Cleveland, Ohio), QuickChange Site Directed mutagenesis (Stratagene, San Diego, Calif.), PCR-mediated site-directed mutagenesis or other site-directed mutagenesis protocols.

Derivatives

"Derivatives" include peptides, oligopeptides, polypeptides which may, compared to the amino acid sequence of the naturally-occurring form of the protein, such as the protein of interest, comprise substitutions of amino acids with non-naturally occurring amino acid residues, or additions of non-naturally occurring amino acid residues. "Derivatives" of a protein also encompass peptides, oligopeptides, polypeptides which comprise naturally occurring altered (glycosylated, acylated, prenylated, phosphorylated, myristoylated, sulphated etc.) or non-naturally altered amino acid residues compared to the amino acid sequence of a naturally-occurring form of the polypeptide. A derivative may also comprise one or more non-amino acid substituents or additions compared to the amino acid sequence from which it is derived, for example a reporter molecule or other ligand, covalently or non-covalently bound to the amino acid sequence, such as a reporter molecule which is bound to facilitate its detection, and non-naturally occurring amino acid residues relative to the amino acid sequence of a naturally-occurring protein. Furthermore, "derivatives" also include fusions of the naturally-occurring form of the protein with tagging peptides such as FLAG, HIS6 or thioredoxin (for a review of tagging peptides, see Terpe, Appl. Microbiol. Biotechnol. 60, 523-533, 2003).

Orthologue(s)/Paralogue(s)

Orthologues and paralogues encompass evolutionary concepts used to describe the ancestral relationships of genes. Paralogues are genes within the same species that have originated through duplication of an ancestral gene; orthologues are genes from different organisms that have originated through speciation, and are also derived from a common ancestral gene.

Domain, Motif/Consensus Sequence/Signature

The term "domain" refers to a set of amino acids conserved at specific positions along an alignment of sequences of evolutionarily related proteins. While amino acids at other positions can vary between homologues, amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide family.

The term "motif" or "consensus sequence" or "signature" refers to a short conserved region in the sequence of evolutionarily related proteins. Motifs are frequently highly conserved parts of domains, but may also include only part of the domain, or be located outside of conserved domain (if all of the amino acids of the motif fall outside of a defined domain).

Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244), InterPro (Mulder et al., (2003) Nucl. Acids. Res. 31, 315-318), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAI Press, Menlo Park; Hulo et al., Nucl. Acids. Res. 32:D134-D137, (2004)), or Pfam (Bateman et al., Nucleic Acids Research 30(1): 276-280 (2002)). A set of tools for in silico analysis of protein sequences is available on the ExPASy proteomics server (Swiss Institute of Bioinformatics (Gasteiger et al., ExPASy: the proteomics server for in-depth protein knowledge and analysis, Nucleic Acids Res. 31:3784-3788 (2003)). Domains or motifs may also be identified using routine techniques, such as by sequence alignment.

Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences.). Minor manual editing may be performed to optimise alignment between conserved motifs, as would be apparent to a person skilled in the art. Furthermore, instead of using full-length sequences for the identification of homologues, specific domains may also be used. The sequence identity values may be determined over the entire nucleic acid or amino acid sequence or over selected domains or conserved motif(s), using the programs mentioned above using the default parameters. For local alignments, the Smith-Waterman algorithm is particularly useful (Smith T F, Waterman M S (1981) J. Mol. Biol 147(1); 195-7).

Reciprocal BLAST

Typically, this involves a first BLAST involving BLASTing a query sequence (for example using any of the sequences listed in Table A2, A3, A4, A5 or A6 of the Examples section) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived. The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

Hybridisation

The term "hybridisation" as defined herein is a process wherein substantially homologous complementary nucleotide sequences anneal to each other. The hybridisation process can occur entirely in solution, i.e. both complementary nucleic acids are in solution. The hybridisation process can also occur with one of the complementary nucleic acids immobilised to a matrix such as magnetic beads, Sepharose beads or any other resin. The hybridisation process can furthermore occur with one of the complementary nucleic acids immobilised to a solid support such as a nitro-cellulose or nylon membrane or immobilised by e.g. photolithography to, for example, a siliceous glass support (the latter known as nucleic acid arrays or microarrays or as nucleic acid chips). In order to allow hybridisation to occur, the nucleic acid molecules are generally thermally or chemically denatured to melt a double strand into two single strands and/or to remove hairpins or other secondary structures from single stranded nucleic acids.

The term "stringency" refers to the conditions under which a hybridisation takes place. The stringency of hybridisation is influenced by conditions such as temperature, salt concentration, ionic strength and hybridisation buffer composition. Generally, low stringency conditions are selected to be about 30° C. lower than the thermal melting point ($T_m$) for the specific sequence at a defined ionic strength and pH. Medium stringency conditions are when the temperature is 20° C. below $T_m$, and high stringency conditions are when the temperature is 10° C. below $T_m$. High stringency hybridisation conditions are typically used for isolating hybridising sequences that have high sequence similarity to the target nucleic acid sequence. However, nucleic acids may deviate in sequence and still encode a substantially identical polypeptide, due to the degeneracy of the genetic code. Therefore medium stringency hybridisation conditions may sometimes be needed to identify such nucleic acid molecules.

The Tm is the temperature under defined ionic strength and pH, at which 50% of the target sequence hybridises to a perfectly matched probe. The $T_m$ is dependent upon the solution conditions and the base composition and length of the probe. For example, longer sequences hybridise specifically at higher temperatures. The maximum rate of hybridisation is obtained from about 16° C. up to 32° C. below $T_m$. The presence of monovalent cations in the hybridisation solution reduce the electrostatic repulsion between the two nucleic acid strands thereby promoting hybrid formation; this effect is visible for sodium concentrations of up to 0.4M (for higher concentrations, this effect may be ignored). Formamide reduces the melting temperature of DNA-DNA and DNA-RNA duplexes with 0.6 to 0.7° C. for each percent formamide, and addition of 50% formamide allows hybridisation to be performed at 30 to 45° C., though the rate of hybridisation will be lowered. Base pair mismatches reduce the hybridisation rate and the thermal stability of the duplexes. On average and for large probes, the Tm decreases about 1° C. per % base mismatch. The Tm may be calculated using the following equations, depending on the types of hybrids:

1) DNA-DNA hybrids (Meinkoth and Wahl, Anal. Biochem., 138: 267-284, 1984):

$$T_m=81.5° C.+16.6\times\log_{10}[Na^+]^a+0.41\times\%[G/C_b]-500\times[L^c]^{-1}-0.61\times\% \text{ formamide}$$

2) DNA-RNA or RNA-RNA hybrids:

$$Tm=79.8+18.5(\log_{10}[Na^+]^a)+0.58(\%G/C^b)+11.8(\%G/C^b)^2-820/L^c$$

3) oligo-DNA or oligo-RNAs hybrids:
   For <20 nucleotides: $T_m=2 (I_n)$
   For 20-35 nucleotides: $T_m=22+1.46 (I_n)$ $^a$ or for other monovalent cation, but only accurate in the 0.01-0.4 M range.
$^b$ only accurate for % GC in the 30% to 75% range.
$^c$ L=length of duplex in base pairs.
$^d$ oligo, oligonucleotide; $I_n$=effective length of primer=2× (no. of G/C)+(no. of NT).

Non-specific binding may be controlled using any one of a number of known techniques such as, for example, blocking the membrane with protein containing solutions, additions of heterologous RNA, DNA, and SDS to the hybridisation buffer, and treatment with Rnase. For non-homologous probes, a series of hybridizations may be performed by varying one of (i) progressively lowering the annealing temperature (for example from 68° C. to 42° C.) or (ii) progressively lowering the formamide concentration (for example from 50% to 0%). The skilled artisan is aware of various parameters which may be altered during hybridisation and which will either maintain or change the stringency conditions.

Besides the hybridisation conditions, specificity of hybridisation typically also depends on the function of post-hybridisation washes. To remove background resulting from non-specific hybridisation, samples are washed with dilute salt solutions. Critical factors of such washes include the ionic strength and temperature of the final wash solution: the lower the salt concentration and the higher the wash temperature, the higher the stringency of the wash. Wash conditions are typically performed at or below hybridisation stringency. A positive hybridisation gives a signal that is at least twice of that of the background. Generally, suitable stringent conditions for nucleic acid hybridisation assays or gene amplification detection procedures are as set forth above. More or less stringent conditions may also be selected. The skilled artisan is aware of various parameters which may be altered during washing and which will either maintain or change the stringency conditions.

For example, typical high stringency hybridisation conditions for DNA hybrids longer than 50 nucleotides encompass hybridisation at 65° C. in 1×SSC or at 42° C. in 1×SSC and 50% formamide, followed by washing at 65° C. in 0.3×SSC. Examples of medium stringency hybridisation conditions for DNA hybrids longer than 50 nucleotides encompass hybridisation at 50° C. in 4×SSC or at 40° C. in 6×SSC and 50% formamide, followed by washing at 50° C. in 2×SSC. The length of the hybrid is the anticipated length for the hybridising nucleic acid. When nucleic acids of known sequence are hybridised, the hybrid length may be determined by aligning the sequences and identifying the conserved regions described herein. 1×SSC is 0.15M NaCl and 15 mM sodium citrate; the hybridisation solution and wash solutions may additionally include 5×Denhardt's reagent, 0.5-1.0% SDS, 100 μg/ml denatured, fragmented salmon sperm DNA, 0.5% sodium pyrophosphate.

For the purposes of defining the level of stringency, reference can be made to Sambrook et al. (2001) Molecular Cloning: a laboratory manual, 3rd Edition, Cold Spring Harbor Laboratory Press, CSH, New York or to Current Protocols in Molecular Biology, John Wiley & Sons, N.Y. (1989 and yearly updates).

Splice Variant

The term "splice variant" as used herein encompasses variants of a nucleic acid sequence in which selected introns and/or exons have been excised, replaced, displaced or added, or in which introns have been shortened or lengthened. Such variants will be ones in which the biological activity of the protein is substantially retained; this may be achieved by selectively retaining functional segments of the protein. Such splice variants may be found in nature or may be manmade. Methods for predicting and isolating such splice variants are well known in the art (see for example Foissac and Schiex (2005) BMC Bioinformatics 6: 25).

Allelic Variant

Alleles or allelic variants are alternative forms of a given gene, located at the same chromosomal position. Allelic variants encompass Single Nucleotide Polymorphisms (SNPs), as well as Small Insertion/Deletion Polymorphisms (INDELs). The size of INDELs is usually less than 100 bp. SNPs and INDELs form the largest set of sequence variants in naturally occurring polymorphic strains of most organisms.

Endogenous Gene

Reference herein to an "endogenous" gene not only refers to the gene in question as found in a plant in its natural form (i.e., without there being any human intervention), but also refers to that same gene (or a substantially homologous nucleic acid/gene) in an isolated form subsequently (re) introduced into a plant (a transgene). For example, a transgenic plant containing such a transgene may encounter a substantial reduction of the transgene expression and/or substantial reduction of expression of the endogenous gene.

The isolated gene may be isolated from an organism or may be manmade, for example by chemical synthesis.

Gene Shuffling/Directed Evolution

Gene shuffling or directed evolution consists of iterations of DNA shuffling followed by appropriate screening and/or selection to generate variants of nucleic acids or portions thereof encoding proteins having a modified biological activity (Castle et al., (2004) Science 304(5674): 1151-4; U.S. Pat. Nos. 5,811,238 and 6,395,547).

Construct

Additional regulatory elements may include transcriptional as well as translational enhancers. Those skilled in the art will be aware of terminator and enhancer sequences that may be suitable for use in performing the invention. An intron sequence may also be added to the 5' untranslated region (UTR) or in the coding sequence to increase the amount of the mature message that accumulates in the cytosol, as described in the definitions section. Other control sequences (besides promoter, enhancer, silencer, intron sequences, 3'UTR and/or 5'UTR regions) may be protein and/or RNA stabilizing elements. Such sequences would be known or may readily be obtained by a person skilled in the art.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

For the detection of the successful transfer of the nucleic acid sequences as used in the methods of the invention and/or selection of transgenic plants comprising these nucleic acids, it is advantageous to use marker genes (or reporter genes). Therefore, the genetic construct may optionally comprise a selectable marker gene. Selectable markers are described in more detail in the "definitions" section herein. The marker genes may be removed or excised from the transgenic cell once they are no longer needed. Techniques for marker removal are known in the art, useful techniques are described above in the definitions section.

Regulatory Element/Control Sequence/Promoter

The terms "regulatory element", "control sequence" and "promoter" are all used interchangeably herein and are to be taken in a broad context to refer to regulatory nucleic acid sequences capable of effecting expression of the sequences to which they are ligated. The term "promoter" typically refers to a nucleic acid control sequence located upstream from the transcriptional start of a gene and which is involved in recognising and binding of RNA polymerase and other proteins, thereby directing transcription of an operably linked nucleic acid. Encompassed by the aforementioned terms are transcriptional regulatory sequences derived from a classical eukaryotic genomic gene (including the TATA box which is required for accurate transcription initiation, with or without a CCAAT box sequence) and additional regulatory elements (i.e. upstream activating sequences, enhancers and silencers) which alter gene expression in response to developmental and/or external stimuli, or in a tissue-specific manner. Also included within the term is a transcriptional regulatory sequence of a classical prokaryotic gene, in which case it may include a −35 box sequence and/or −10 box transcriptional regulatory sequences. The term "regulatory element" also encompasses a synthetic fusion molecule or derivative that confers, activates or enhances expression of a nucleic acid molecule in a cell, tissue or organ.

A "plant promoter" comprises regulatory elements, which mediate the expression of a coding sequence segment in plant cells. Accordingly, a plant promoter need not be of plant origin, but may originate from viruses or microorganisms, for example from viruses which attack plant cells. The "plant promoter" can also originate from a plant cell, e.g. from the plant which is transformed with the nucleic acid sequence to be expressed in the inventive process and described herein. This also applies to other "plant" regulatory signals, such as "plant" terminators. The promoters upstream of the nucleotide sequences useful in the methods of the present invention can be modified by one or more nucleotide substitution(s), insertion(s) and/or deletion(s) without interfering with the functionality or activity of either the promoters, the open reading frame (ORF) or the 3'-regulatory region such as terminators or other 3' regulatory regions which are located away from the ORF. It is furthermore possible that the activity of the promoters is increased by modification of their sequence, or that they are replaced completely by more active promoters, even promoters from heterologous organisms. For expression in plants, the nucleic acid molecule must, as described above, be linked operably to or comprise a suitable promoter which expresses the gene at the right point in time and with the required spatial expression pattern.

For the identification of functionally equivalent promoters, the promoter strength and/or expression pattern of a candidate promoter may be analysed for example by operably linking the promoter to a reporter gene and assaying the expression level and pattern of the reporter gene in various tissues of the plant. Suitable well-known reporter genes include for example beta-glucuronidase or beta-galactosidase. The promoter activity is assayed by measuring the enzymatic activity of the beta-glucuronidase or beta-galactosidase. The promoter strength and/or expression pattern may then be compared to that of a reference promoter (such as the one used in the methods of the present invention). Alternatively, promoter strength may be assayed by quantifying mRNA levels or by comparing mRNA levels of the nucleic acid used in the methods of the present invention, with mRNA levels of housekeeping genes such as 18S rRNA, using methods known in the art, such as Northern blotting with densitometric analysis of autoradiograms, quantitative real-time PCR or RT-PCR (Heid et al., 1996 Genome Methods 6: 986-994). Generally by "weak promoter" is intended a promoter that drives expression of a coding sequence at a low level. By "low level" is intended at levels of about 1/10,000 transcripts to about 1/100,000 transcripts, to about 1/500,0000 transcripts per cell. Conversely, a "strong promoter" drives expression of a coding sequence at high level, or at about 1/10 transcripts to about 1/100 transcripts to about 1/1000 transcripts per cell. Generally, by "medium strength promoter" is intended a promoter that drives expression of a coding sequence at a lower level than a strong promoter, in particular at a level that is in all instances below that obtained when under the control of a 35S CaMV promoter.

Operably Linked

The term "operably linked" as used herein refers to a functional linkage between the promoter sequence and the gene of interest, such that the promoter sequence is able to initiate transcription of the gene of interest.

Constitutive Promoter

A "constitutive promoter" refers to a promoter that is transcriptionally active during most, but not necessarily all, phases of growth and development and under most environmental conditions, in at least one cell, tissue or organ. Table 2a below gives examples of constitutive promoters.

TABLE 2a

Examples of constitutive promoters

| Gene Source | Reference |
|---|---|
| Actin | McElroy et al, Plant Cell, 2: 163-171, 1990 |
| HMGP | WO 2004/070039 |
| CAMV 35S | Odell et al, Nature, 313: 810-812, 1985 |
| CaMV 19S | Nilsson et al., Physiol. Plant. 100: 456-462, 1997 |
| GOS2 | de Pater et al, Plant J Nov; 2(6): 837-44, 1992, WO 2004/065596 |
| Ubiquitin | Christensen et al, Plant Mol. Biol. 18: 675-689, 1992 |
| Rice cyclophilin | Buchholz et al, Plant Mol Biol. 25(5): 837-43, 1994 |
| Maize H3 histone | Lepetit et al, Mol. Gen. Genet. 231: 276-285, 1992 |
| Alfalfa H3 histone | Wu et al. Plant Mol. Biol. 11: 641-649, 1988 |
| Actin 2 | An et al, Plant J. 10(1); 107-121, 1996 |
| 34S FMV | Sanger et al., Plant. Mol. Biol., 14, 1990: 433-443 |
| Rubisco small subunit | U.S. Pat. No. 4,962,028 |
| OCS | Leisner (1988) Proc Natl Acad Sci USA 85(5): 2553 |
| SAD1 | Jain et al., Crop Science, 39 (6), 1999: 1696 |
| SAD2 | Jain et al., Crop Science, 39 (6), 1999: 1696 |
| nos | Shaw et al. (1984) Nucleic Acids Res. 12(20): 7831-7846 |
| V-ATPase | WO 01/14572 |
| Super promoter | WO 95/14098 |
| G-box proteins | WO 94/12015 |

Ubiquitous Promoter

A ubiquitous promoter is active in substantially all tissues or cells of an organism.

Developmentally-Regulated Promoter

A developmentally-regulated promoter is active during certain developmental stages or in parts of the plant that undergo developmental changes.

Inducible Promoter

An inducible promoter has induced or increased transcription initiation in response to a chemical (for a review see Gatz 1997, Annu. Rev. Plant Physiol. Plant Mol. Biol., 48:89-108), environmental or physical stimulus, or may be "stress-inducible", i.e. activated when a plant is exposed to various stress conditions, or a "pathogen-inducible" i.e. activated when a plant is exposed to exposure to various pathogens.

Organ-Specific/Tissue-Specific Promoter

An organ-specific or tissue-specific promoter is one that is capable of preferentially initiating transcription in certain organs or tissues, such as the leaves, roots, seed tissue etc. For example, a "root-specific promoter" is a promoter that is transcriptionally active predominantly in plant roots, substantially to the exclusion of any other parts of a plant, whilst still allowing for any leaky expression in these other plant parts. Promoters able to initiate transcription in certain cells only are referred to herein as "cell-specific".

Examples of root-specific promoters are listed in Table 2b below:

TABLE 2b

Examples of root-specific promoters

| Gene Source | Reference |
|---|---|
| RCc3 | Plant Mol Biol. 1995 January; 27(2): 237-48 |
| Arabidopsis PHT1 | Kovama et al., 2005; Mudge et al. (2002, Plant J. 31: 341) |
| Medicago phosphate transporter | Xiao et al., 2006 |
| Arabidopsis Pyk10 | Nitz et al. (2001) Plant Sci 161(2): 337-346 |
| root-expressible genes | Tingey et al., EMBO J. 6: 1, 1987. |
| tobacco auxin-inducible gene | Van der Zaal et al., Plant Mol. Biol. 16, 983, 1991. |
| β-tubulin | Oppenheimer, et al., Gene 63: 87, 1988. |
| tobacco root-specific genes | Conkling, et al., Plant Physiol. 93: 1203, 1990. |
| B. napus G1-3b gene | U.S. Pat. No. 5,401,836 |
| SbPRP1 | Suzuki et al., Plant Mol. Biol. 21: 109-119, 1993. |
| LRX1 | Baumberger et al. 2001, Genes & Dev. 15: 1128 |
| BTG-26 Brassica napus | US 20050044585 |
| LeAMT1 (tomato) | Lauter et al. (1996, PNAS 3: 8139) |
| The LeNRT1-1 (tomato) | Lauter et al. (1996, PNAS 3: 8139) |
| class I patatin gene (potato) | Liu et al., Plant Mol. Biol. 153: 386-395, 1991. |
| KDC1 (Daucus carota) | Downey et al. (2000, J. Biol. Chem. 275: 39420) |
| TobRB7 gene | W Song (1997) PhD Thesis, North Carolina State University, Raleigh, NC USA |
| OsRAB5a (rice) | Wang et al. 2002, Plant Sci. 163: 273 |
| ALF5 (Arabidopsis) | Diener et al. (2001, Plant Cell 13: 1625) |
| NRT2; 1Np (N. plumbaginifolia) | Quesada et al. (1997, Plant Mol. Biol. 34: 265) |

A seed-specific promoter is transcriptionally active predominantly in seed tissue, but not necessarily exclusively in seed tissue (in cases of leaky expression). The seed-specific promoter may be active during seed development and/or during germination. The seed specific promoter may be endosperm/aleurone/embryo specific. Examples of seed-specific promoters (endosperm/aleurone/embryo specific) are shown in Table 2c to Table 2f below. Further examples of seed-specific promoters are given in Qing Qu and Takaiwa (Plant Biotechnol. J. 2, 113-125, 2004), which disclosure is incorporated by reference herein as if fully set forth.

TABLE 2c

Examples of seed-specific promoters

| Gene source | Reference |
|---|---|
| seed-specific genes | Simon et al., Plant Mol. Biol. 5: 191, 1985; Scofield et al., J. Biol. Chem. 262: 12202, 1987.; Baszczynski et al., Plant Mol. Biol. 14: 633, 1990. |
| Brazil Nut albumin | Pearson et al., Plant Mol. Biol. 18: 235-245, 1992. |
| legumin | Ellis et al., Plant Mol. Biol. 10: 203-214, 1988. |
| glutelin (rice) | Takaiwa et al., Mol. Gen. Genet. 208: 15-22, 1986; Takaiwa et al., FEBS Letts. 221: 43-47, 1987. |

TABLE 2c-continued

Examples of seed-specific promoters

| Gene source | Reference |
|---|---|
| zein | Matzke et al Plant Mol Biol, 14(3): 323-32 1990 |
| napA | Stalberg et al, Planta 199: 515-519, 1996. |
| wheat LMW and HMW glutenin-1 | Mol Gen Genet 216: 81-90, 1989; NAR 17: 461-2, 1989 |
| wheat SPA | Albani et al, Plant Cell, 9: 171-184, 1997 |
| wheat α, β, γ-gliadins | EMBO J. 3: 1409-15, 1984 |
| barley Itr1 promoter | Diaz et al. (1995) Mol Gen Genet 248(5): 592-8 |
| barley B1, C, D, hordein | Theor Appl Gen 98: 1253-62, 1999; Plant J 4: 343-55, 1993; Mol Gen Genet 250: 750-60, 1996 |
| barley DOF | Mena et al, The Plant Journal, 116(1): 53-62, 1998 |
| blz2 | EP99106056.7 |
| synthetic promoter | Vicente-Carbajosa et al., Plant J. 13: 629-640, 1998. |
| rice prolamin NRP33 | Wu et al, Plant Cell Physiology 39(8) 885-889, 1998 |
| rice a-globulin Glb-1 | Wu et al, Plant Cell Physiology 39(8) 885-889, 1998 |
| rice OSH1 | Sato et al, Proc. Natl. Acad. Sci. USA, 93: 8117-8122, 1996 |
| rice α-globulin REB/OHP-1 | Nakase et al. Plant Mol. Biol. 33: 513-522, 1997 |
| rice ADP-glucose pyrophosphorylase | Trans Res 6: 157-68, 1997 |
| maize ESR gene family | Plant J 12: 235-46, 1997 |
| *sorghum* α-kafirin | DeRose et al., Plant Mol. Biol 32: 1029-35, 1996 |
| KNOX | Postma-Haarsma et al, Plant Mol. Biol. 39: 257-71, 1999 |
| rice oleosin | Wu et al, J. Biochem. 123: 386, 1998 |
| sunflower oleosin | Cummins et al., Plant Mol. Biol. 19: 873-876, 1992 |
| PRO0117, putative rice 40S ribosomal protein | WO 2004/070039 |
| PRO0136, rice alanine aminotransferase | unpublished |
| PRO0147, trypsin inhibitor ITR1 (barley) | unpublished |
| PRO0151, rice WSI18 | WO 2004/070039 |
| PRO0175, rice RAB21 | WO 2004/070039 |
| PRO005 | WO 2004/070039 |
| PRO0095 | WO 2004/070039 |
| α-amylase (Amy32b) | Lanahan et al, Plant Cell 4: 203-211, 1992; Skriver et al, Proc Natl Acad Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

TABLE 2d examples of endosperm-specific promoters

| Gene source | Reference |
|---|---|
| glutelin (rice) | Takaiwa et al. (1986) Mol Gen Genet 208: 15-22; Takaiwa et al. (1987) FEBS Letts. 221: 43-47 |
| zein | Matzke et al., (1990) Plant Mol Biol 14(3): 323-32 |
| wheat LMW and HMW glutenin-1 | Colot et al. (1989) Mol Gen Genet 216: 81-90, Anderson et al. (1989) NAR 17: 461-2 |
| wheat SPA | Albani et al. (1997) Plant Cell 9: 171-184 |
| wheat gliadins | Rafalski et al. (1984) EMBO 3: 1409-15 |
| barley Itr1 promoter | Diaz et al. (1995) Mol Gen Genet 248(5): 592-8 |
| barley B1, C, D, hordein | Cho et al. (1999) Theor Appl Genet 98: 1253-62; Muller et al. (1993) Plant J 4: 343-55; Sorenson et al. (1996) Mol Gen Genet 250: 750-60 |
| barley DOF | Mena et al, (1998) Plant J 116(1): 53-62 |
| blz2 | Onate et al. (1999) J Biol Chem 274(14): 9175-82 |
| synthetic promoter | Vicente-Carbajosa et al. (1998) Plant J 13: 629-640 |
| rice prolamin NRP33 | Wu et al, (1998) Plant Cell Physiol 39(8) 885-889 |
| rice globulin Glb-1 | Wu et al. (1998) Plant Cell Physiol 39(8) 885-889 |
| rice globulin REB/OHP-1 | Nakase et al. (1997) Plant Molec Biol 33: 513-522 |
| rice ADP-glucose pyrophosphorylase | Russell et al. (1997) Trans Res 6: 157-68 |
| maize ESR gene family | Opsahl-Ferstad et al. (1997) Plant J 12: 235-46 |
| *sorghum* kafirin | DeRose et al. (1996) Plant Mol Biol 32: 1029-35 |

TABLE 2e

Examples of embryo specific promoters:

| Gene source | Reference |
|---|---|
| rice OSH1 | Sato et al, Proc. Natl. Acad. Sci. USA, 93: 8117-8122, 1996 |
| KNOX | Postma-Haarsma et al, Plant Mol. Biol. 39: 257-71, 1999 |
| PRO0151 | WO 2004/070039 |
| PRO0175 | WO 2004/070039 |
| PRO005 | WO 2004/070039 |
| PRO0095 | WO 2004/070039 |

TABLE 2f

Examples of aleurone-specific promoters:

| Gene source | Reference |
|---|---|
| α-amylase (Amy32b) | Lanahan et al, Plant Cell 4: 203-211, 1992; Skriver et al, Proc Natl Acad Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

A green tissue-specific promoter as defined herein is a promoter that is transcriptionally active predominantly in green tissue, substantially to the exclusion of any other parts of a plant, whilst still allowing for any leaky expression in these other plant parts.

Examples of green tissue-specific promoters which may be used to perform the methods of the invention are shown in Table 2g below.

TABLE 2g

Examples of green tissue-specific promoters

| Gene | Expression | Reference |
|---|---|---|
| Maize Orthophosphate dikinase | Leaf specific | Fukayama et al., 2001 |
| Maize Phosphoenolpyruvate carboxylase | Leaf specific | Kausch et al., 2001 |
| Rice Phosphoenolpyruvate carboxylase | Leaf specific | Liu et al., 2003 |
| Rice small subunit Rubisco | Leaf specific | Nomura et al., 2000 |
| rice beta expansin EXBP9 | Shoot specific | WO 2004/070039 |
| Pigeonpea small subunit Rubisco | Leaf specific | Panguluri et al., 2005 |
| Pea RBCS3A | Leaf specific | |

Another example of a tissue-specific promoter is a meristem-specific promoter, which is transcriptionally active predominantly in meristematic tissue, substantially to the exclusion of any other parts of a plant, whilst still allowing for any leaky expression in these other plant parts. Examples of green meristem-specific promoters which may be used to perform the methods of the invention are shown in Table 2h below.

TABLE 2h

Examples of meristem-specific promoters

| Gene source | Expression pattern | Reference |
|---|---|---|
| rice OSH1 | Shoot apical meristem, from embryo globular stage to seedling stage | Sato et al. (1996) Proc. Natl. Acad. Sci. USA, 93: 8117-8122 |
| Rice metallothionein | Meristem specific | BAD87835.1 |
| WAK1 & WAK 2 | Shoot and root apical meristems, and in expanding leaves and sepals | Wagner & Kohorn (2001) Plant Cell 13(2): 303-318 |

Terminator

The term "terminator" encompasses a control sequence which is a DNA sequence at the end of a transcriptional unit which signals 3' processing and polyadenylation of a primary transcript and termination of transcription. The terminator can be derived from the natural gene, from a variety of other plant genes, or from T-DNA. The terminator to be added may be derived from, for example, the nopaline synthase or octopine synthase genes, or alternatively from another plant gene, or less preferably from any other eukaryotic gene.

Selectable Marker (Gene)/Reporter Gene

"Selectable marker", "selectable marker gene" or "reporter gene" includes any gene that confers a phenotype on a cell in which it is expressed to facilitate the identification and/or selection of cells that are transfected or transformed with a nucleic acid construct of the invention. These marker genes enable the identification of a successful transfer of the nucleic acid molecules via a series of different principles. Suitable markers may be selected from markers that confer antibiotic or herbicide resistance, that introduce a new metabolic trait or that allow visual selection. Examples of selectable marker genes include genes conferring resistance to antibiotics (such as nptII that phosphorylates neomycin and kanamycin, or hpt, phosphorylating hygromycin, or genes conferring resistance to, for example, bleomycin, streptomycin, tetracyclin, chloramphenicol, ampicillin, gentamycin, geneticin (G418), spectinomycin or blasticidin), to herbicides (for example bar which provides resistance to Basta®; aroA or gox providing resistance against glyphosate, or the genes conferring resistance to, for example, imidazolinone, phosphinothricin or sulfonylurea), or genes that provide a metabolic trait (such as manA that allows plants to use mannose as sole carbon source or xylose isomerase for the utilisation of xylose, or antinutritive markers such as the resistance to 2-deoxyglucose). Expression of visual marker genes results in the formation of colour (for example β-glucuronidase, GUS or β-galactosidase with its coloured substrates, for example X-Gal), luminescence (such as the luciferin/luceferase system) or fluorescence (Green Fluorescent Protein, GFP, and derivatives thereof). This list represents only a small number of possible markers. The skilled worker is familiar with such markers. Different markers are preferred, depending on the organism and the selection method.

It is known that upon stable or transient integration of nucleic acids into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest. These markers can for example be used in mutants in which these genes are not functional by, for example, deletion by conventional methods. Furthermore, nucleic acid molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid can be identified for example by selection (for example, cells which have integrated the selectable marker survive whereas the other cells die).

Since the marker genes, particularly genes for resistance to antibiotics and herbicides, are no longer required or are undesired in the transgenic host cell once the nucleic acids have been introduced successfully, the process according to the invention for introducing the nucleic acids advantageously employs techniques which enable the removal or excision of these marker genes. One such a method is what is known as co-transformation. The co-transformation method employs two vectors simultaneously for the transformation, one vector bearing the nucleic acid according to the invention and a second bearing the marker gene(s). A large proportion of transformants receives or, in the case of plants, comprises (up to 40% or more of the transformants), both vectors. In case of transformation with Agrobacteria, the transformants usually receive only a part of the vector, i.e. the sequence flanked by the T-DNA, which usually represents the expression cassette. The marker genes can subsequently be removed from the transformed plant by performing crosses. In another method, marker genes integrated into a transposon are used for the transformation together with desired nucleic acid (known as the Ac/Ds technology). The transformants can be crossed with a transposase source or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases the marker gene must be eliminated by performing crosses. In microbiology, techniques were developed which make possible, or facilitate, the detection of such events. A further advantageous method relies on what is known as recombination systems; whose advantage is that elimination by crossing can be dispensed with. The best-known system of this type is what is known as the Cre/lox system. Cre1 is a recombinase that removes the sequences located between the loxP sequences. If the marker gene is integrated between the loxP sequences, it is removed once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.

Transgenic/Transgene/Recombinant

For the purposes of the invention, "transgenic", "transgene" or "recombinant" means with regard to, for example, a nucleic acid sequence, an expression cassette, gene construct or a vector comprising the nucleic acid sequence or an organism transformed with the nucleic acid sequences, expression cassettes or vectors according to the invention, all those constructions brought about by recombinant methods in which either (a) the nucleic acid sequences encoding proteins useful in the methods of the invention, or
(b) genetic control sequence(s) which is operably linked with the nucleic acid sequence according to the invention, for example a promoter, or
(c) a) and b)

are not located in their natural genetic environment or have been modified by recombinant methods, it being possible for the modification to take the form of, for example, a substitution, addition, deletion, inversion or insertion of one or more nucleotide residues. The natural genetic environment is understood as meaning the natural genomic or chromosomal locus in the original plant or the presence in a genomic library. In the case of a genomic library, the natural genetic environment of the nucleic acid sequence is preferably retained, at least in part. The environment flanks the nucleic acid sequence at least on one side and has a sequence length of at least 50 bp, preferably at least 500 bp, especially preferably at least 1000 bp, most preferably at least 5000 bp. A naturally occurring expression cassette—for example the naturally occurring combination of the natural promoter of the nucleic acid sequences with the corresponding nucleic acid sequence encoding a polypeptide useful in the methods of the present invention, as defined above—becomes a transgenic expression cassette when this expression cassette is modified by non-natural, synthetic ("artificial") methods such as, for example, mutagenic treatment. Suitable methods are described, for example, in U.S. Pat. No. 5,565,350 or WO 00/15815.

A transgenic plant for the purposes of the invention is thus understood as meaning, as above, that the nucleic acids used in the method of the invention are not at their natural locus in the genome of said plant, it being possible for the nucleic acids to be expressed homologously or heterologously. However, as mentioned, transgenic also means that, while the nucleic acids according to the invention or used in the inventive method are at their natural position in the genome of a plant, the sequence has been modified with regard to the natural sequence, and/or that the regulatory sequences of the natural sequences have been modified. Transgenic is preferably understood as meaning the expression of the nucleic acids according to the invention at an unnatural locus in the genome, i.e. homologous or, preferably, heterologous expression of the nucleic acids takes place. Preferred transgenic plants are mentioned herein.

Modulation

The term "modulation" means in relation to expression or gene expression, a process in which the expression level is changed by said gene expression in comparison to the control plant, the expression level may be increased or decreased. The original, unmodulated expression may be of any kind of expression of a structural RNA (rRNA, tRNA) or mRNA with subsequent translation. The term "modulating the activity" shall mean any change of the expression of the inventive nucleic acid sequences or encoded proteins, which leads to increased yield and/or increased growth of the plants.

Expression

The term "expression" or "gene expression" means the transcription of a specific gene or specific genes or specific genetic construct. The term "expression" or "gene expression" in particular means the transcription of a gene or genes or genetic construct into structural RNA (rRNA, tRNA) or mRNA with or without subsequent translation of the latter into a protein. The process includes transcription of DNA and processing of the resulting mRNA product.

Increased Expression/Overexpression

The term "increased expression" or "overexpression" as used herein means any form of expression that is additional to the original wild-type expression level.

Methods for increasing expression of genes or gene products are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression of a nucleic acid encoding the polypeptide of interest. For example, endogenous promoters may be altered in vivo by mutation, deletion, and/or substitution (see, Kmiec, U.S. Pat. No. 5,565,350; Zarling et al., WO9322443), or isolated promoters may be introduced into a plant cell in the proper orientation and distance from a gene of the present invention so as to control the expression of the gene.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added to the 5' untranslated region (UTR) or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg (1988) Mol. Cell biol. 8: 4395-4405; Callis et al. (1987) Genes Dev 1:1183-1200). Such intron enhancement of gene expression is typically greatest when placed near the 5' end of the transcription unit. Use of the maize introns Adh1-S intron 1, 2, and 6, the Bronze-1 intron are known in the art. For general information see: The Maize Handbook, Chapter 116, Freeling and Walbot, Eds., Springer, N.Y. (1994).

Decreased Expression

Reference herein to "decreased expression" or "reduction or substantial elimination" of expression is taken to mean a decrease in endogenous gene expression and/or polypeptide levels and/or polypeptide activity relative to control plants. The reduction or substantial elimination is in increasing order of preference at least 10%, 20%, 30%, 40% or 50%, 60%, 70%, 80%, 85%, 90%, or 95%, 96%, 97%, 98%, 99% or more reduced compared to that of control plants.

For the reduction or substantial elimination of expression an endogenous gene in a plant, a sufficient length of substantially contiguous nucleotides of a nucleic acid sequence is required. In order to perform gene silencing, this may be as little as 20, 19, 18, 17, 16, 15, 14, 13, 12, 11, 10 or fewer nucleotides, alternatively this may be as much as the entire gene (including the 5' and/or 3' UTR, either in part or in whole). The stretch of substantially contiguous nucleotides may be derived from the nucleic acid encoding the protein of interest (target gene), or from any nucleic acid capable of encoding an orthologue, paralogue or homologue of the protein of interest. Preferably, the stretch of substantially contiguous nucleotides is capable of forming hydrogen bonds with the target gene (either sense or antisense strand), more preferably, the stretch of substantially contiguous nucleotides has, in increasing order of preference, 50%, 60%, 70%, 80%, 85%, 90%, 95%, 96%, 97%, 98%, 99%, 100% sequence identity to the target gene (either sense or antisense strand). A nucleic acid sequence encoding a (functional) polypeptide is not a requirement for the various methods discussed herein for the reduction or substantial elimination of expression of an endogenous gene.

This reduction or substantial elimination of expression may be achieved using routine tools and techniques. A preferred method for the reduction or substantial elimination of endogenous gene expression is by introducing and expressing in a plant a genetic construct into which the nucleic acid (in this case a stretch of substantially contiguous nucleotides derived from the gene of interest, or from any nucleic acid capable of encoding an orthologue, paralogue or homologue of any one of the protein of interest) is cloned as an inverted repeat (in part or completely), separated by a spacer (non-coding DNA).

In such a preferred method, expression of the endogenous gene is reduced or substantially eliminated through RNA-mediated silencing using an inverted repeat of a nucleic acid or a part thereof (in this case a stretch of substantially contiguous nucleotides derived from the gene of interest, or from any nucleic acid capable of encoding an orthologue, paralogue or homologue of the protein of interest), preferably capable of forming a hairpin structure. The inverted repeat is cloned in an expression vector comprising control sequences. A non-coding DNA nucleic acid sequence (a spacer, for example a matrix attachment region fragment (MAR), an intron, a polylinker, etc.) is located between the two inverted nucleic acids forming the inverted repeat. After transcription of the inverted repeat, a chimeric RNA with a self-complementary structure is formed (partial or complete). This double-stranded RNA structure is referred to as the hairpin RNA (hpRNA). The hpRNA is processed by the plant into siRNAs that are incorporated into an RNA-induced silencing complex (RISC). The RISC further cleaves the mRNA transcripts, thereby substantially reducing the number of mRNA transcripts to be translated into polypeptides. For further general details see for example, Grierson et al. (1998) WO 98/53083; Waterhouse et al. (1999) WO 99/53050).

Performance of the methods of the invention does not rely on introducing and expressing in a plant a genetic construct into which the nucleic acid is cloned as an inverted repeat, but any one or more of several well-known "gene silencing" methods may be used to achieve the same effects.

One such method for the reduction of endogenous gene expression is RNA-mediated silencing of gene expression (downregulation). Silencing in this case is triggered in a plant by a double stranded RNA sequence (dsRNA) that is substantially similar to the target endogenous gene. This dsRNA is further processed by the plant into about 20 to about 26 nucleotides called short interfering RNAs (siRNAs). The siRNAs are incorporated into an RNA-induced silencing complex (RISC) that cleaves the mRNA transcript of the endogenous target gene, thereby substantially reducing the number of mRNA transcripts to be translated into a polypeptide. Preferably, the double stranded RNA sequence corresponds to a target gene.

Another example of an RNA silencing method involves the introduction of nucleic acid sequences or parts thereof (in this case a stretch of substantially contiguous nucleotides derived from the gene of interest, or from any nucleic acid capable of encoding an orthologue, paralogue or homologue of the protein of interest) in a sense orientation into a plant. "Sense orientation" refers to a DNA sequence that is homologous to an mRNA transcript thereof. Introduced into a plant would therefore be at least one copy of the nucleic acid sequence. The additional nucleic acid sequence will reduce expression of the endogenous gene, giving rise to a phenomenon known as co-suppression. The reduction of gene expression will be more pronounced if several additional copies of a nucleic acid sequence are introduced into the plant, as there is a positive correlation between high transcript levels and the triggering of co-suppression.

Another example of an RNA silencing method involves the use of antisense nucleic acid sequences. An "antisense" nucleic acid sequence comprises a nucleotide sequence that is complementary to a "sense" nucleic acid sequence encoding a protein, i.e. complementary to the coding strand of a double-stranded cDNA molecule or complementary to an mRNA transcript sequence. The antisense nucleic acid sequence is preferably complementary to the endogenous gene to be silenced. The complementarity may be located in the "coding region" and/or in the "non-coding region" of a gene. The term "coding region" refers to a region of the nucleotide sequence comprising codons that are translated into amino acid residues. The term "non-coding region" refers to 5' and 3' sequences that flank the coding region that are transcribed but not translated into amino acids (also referred to as 5' and 3' untranslated regions).

Antisense nucleic acid sequences can be designed according to the rules of Watson and Crick base pairing. The antisense nucleic acid sequence may be complementary to the entire nucleic acid sequence (in this case a stretch of substantially contiguous nucleotides derived from the gene of interest, or from any nucleic acid capable of encoding an orthologue, paralogue or homologue of the protein of interest), but may also be an oligonucleotide that is antisense to only a part of the nucleic acid sequence (including the mRNA 5' and 3' UTR). For example, the antisense oligonucleotide sequence may be complementary to the region surrounding the translation start site of an mRNA transcript encoding a polypeptide. The length of a suitable antisense oligonucleotide sequence is known in the art and may start from about 50, 45, 40, 35, 30, 25, 20, 15 or 10 nucleotides in length or less. An antisense nucleic acid sequence according to the invention may be constructed using chemical synthesis and enzymatic ligation reactions using methods known in the art. For example, an antisense nucleic acid sequence (e.g., an antisense oligonucleotide sequence) may be chemically synthesized using naturally occurring nucleotides or variously modified nucleotides designed to increase the biological stability of the molecules or to increase the physical stability of the duplex formed between the antisense and sense nucleic acid sequences, e.g., phosphorothioate derivatives and acridine substituted nucleotides may be used. Examples of modified nucleotides that may be used to generate the antisense nucleic acid sequences are well known in the art. Known nucleotide modifications include methylation, cyclization and 'caps' and substitution of one or more of the naturally occurring nucleotides with an analogue such as inosine. Other modifications of nucleotides are well known in the art.

The antisense nucleic acid sequence can be produced biologically using an expression vector into which a nucleic acid sequence has been subcloned in an antisense orientation (i.e., RNA transcribed from the inserted nucleic acid will be of an antisense orientation to a target nucleic acid of interest). Preferably, production of antisense nucleic acid sequences in plants occurs by means of a stably integrated nucleic acid construct comprising a promoter, an operably linked antisense oligonucleotide, and a terminator.

The nucleic acid molecules used for silencing in the methods of the invention (whether introduced into a plant or generated in situ) hybridize with or bind to mRNA transcripts and/or genomic DNA encoding a polypeptide to thereby inhibit expression of the protein, e.g., by inhibiting transcription and/or translation. The hybridization can be by conventional nucleotide complementarity to form a stable duplex, or, for example, in the case of an antisense nucleic acid sequence which binds to DNA duplexes, through specific interactions in the major groove of the double helix. Antisense nucleic acid sequences may be introduced into a plant by transformation or direct injection at a specific tissue site. Alternatively, antisense nucleic acid sequences can be modified to target selected cells and then administered systemically. For example, for systemic administration, antisense nucleic acid sequences can be modified such that they specifically bind to receptors or antigens expressed on a selected cell surface, e.g., by linking the antisense nucleic acid sequence to peptides or antibodies which bind to cell surface receptors or antigens. The antisense nucleic acid sequences can also be delivered to cells using the vectors described herein.

According to a further aspect, the antisense nucleic acid sequence is an a-anomeric nucleic acid sequence. An a-anomeric nucleic acid sequence forms specific double-stranded hybrids with complementary RNA in which, contrary to the usual b-units, the strands run parallel to each other (Gaultier et al. (1987) Nucl Ac Res 15: 6625-6641). The antisense nucleic acid sequence may also comprise a 2'-o-methylribonucleotide (Inoue et al. (1987) Nucl Ac Res 15, 6131-6148) or a chimeric RNA-DNA analogue (Inoue et al. (1987) FEBS Lett. 215, 327-330).

The reduction or substantial elimination of endogenous gene expression may also be performed using ribozymes. Ribozymes are catalytic RNA molecules with ribonuclease activity that are capable of cleaving a single-stranded nucleic acid sequence, such as an mRNA, to which they have a complementary region. Thus, ribozymes (e.g., hammerhead ribozymes (described in Haselhoff and Gerlach (1988) Nature 334, 585-591) can be used to catalytically cleave mRNA transcripts encoding a polypeptide, thereby substantially reducing the number of mRNA transcripts to be translated into a polypeptide. A ribozyme having specificity for a nucleic acid sequence can be designed (see for example: Cech et al. U.S. Pat. No. 4,987,071; and Cech et al. U.S. Pat. No. 5,116,742). Alternatively, mRNA transcripts corresponding to a nucleic acid sequence can be used to select a catalytic RNA having a specific ribonuclease activity from a pool of RNA molecules (Bartel and Szostak (1993) Science 261, 1411-1418). The use of ribozymes for gene silencing in plants is known in the art (e.g., Atkins et al. (1994) WO 94/00012; Lenne et al. (1995) WO 95/03404; Lutziger et al. (2000) WO 00/00619; Prinsen et al. (1997) WO 97/13865 and Scott et al. (1997) WO 97/38116).

Gene silencing may also be achieved by insertion mutagenesis (for example, T-DNA insertion or transposon insertion) or by strategies as described by, among others, Angell and Baulcombe ((1999) Plant J 20(3): 357-62), (Amplicon VIGS WO 98/36083), or Baulcombe (WO 99/15682).

Gene silencing may also occur if there is a mutation on an endogenous gene and/or a mutation on an isolated gene/nucleic acid subsequently introduced into a plant. The reduction or substantial elimination may be caused by a non-functional polypeptide. For example, the polypeptide may bind to various interacting proteins; one or more mutation(s) and/or truncation(s) may therefore provide for a polypeptide that is still able to bind interacting proteins (such as receptor proteins) but that cannot exhibit its normal function (such as signalling ligand).

A further approach to gene silencing is by targeting nucleic acid sequences complementary to the regulatory region of the gene (e.g., the promoter and/or enhancers) to form triple helical structures that prevent transcription of the gene in target cells. See Helene, C., Anticancer Drug Res. 6, 569-84, 1991; Helene et al., Ann. N.Y. Acad. Sci. 660, 27-36 1992; and Maher, L. J. Bioassays 14, 807-15, 1992.

Other methods, such as the use of antibodies directed to an endogenous polypeptide for inhibiting its function in planta, or interference in the signalling pathway in which a polypeptide is involved, will be well known to the skilled man. In particular, it can be envisaged that manmade molecules may be useful for inhibiting the biological function of a target polypeptide, or for interfering with the signalling pathway in which the target polypeptide is involved.

Alternatively, a screening program may be set up to identify in a plant population natural variants of a gene, which variants encode polypeptides with reduced activity. Such natural variants may also be used for example, to perform homologous recombination.

Artificial and/or natural microRNAs (miRNAs) may be used to knock out gene expression and/or mRNA translation. Endogenous miRNAs are single stranded small RNAs of typically 19-24 nucleotides long. They function primarily to regulate gene expression and/or mRNA translation. Most plant microRNAs (miRNAs) have perfect or near-perfect complementarity with their target sequences. However, there are natural targets with up to five mismatches. They are processed from longer non-coding RNAs with characteristic fold-back structures by double-strand specific RNases of the Dicer family. Upon processing, they are incorporated in the RNA-induced silencing complex (RISC) by binding to its main component, an Argonaute protein. MiRNAs serve as the specificity components of RISC, since they base-pair to target nucleic acids, mostly mRNAs, in the cytoplasm. Subsequent regulatory events include target mRNA cleavage and destruction and/or translational inhibition. Effects of miRNA overexpression are thus often reflected in decreased mRNA levels of target genes.

Artificial microRNAs (amiRNAs), which are typically 21 nucleotides in length, can be genetically engineered specifically to negatively regulate gene expression of single or multiple genes of interest. Determinants of plant microRNA target selection are well known in the art. Empirical parameters for target recognition have been defined and can be used to aid in the design of specific amiRNAs, (Schwab et al., Dev. Cell 8, 517-527, 2005). Convenient tools for design and generation of amiRNAs and their precursors are also available to the public (Schwab et al., Plant Cell 18, 1121-1133, 2006).

For optimal performance, the gene silencing techniques used for reducing expression in a plant of an endogenous gene requires the use of nucleic acid sequences from monocotyledonous plants for transformation of monocotyledonous plants, and from dicotyledonous plants for transformation of dicotyledonous plants. Preferably, a nucleic acid sequence from any given plant species is introduced into that same species. For example, a nucleic acid sequence from rice is transformed into a rice plant. However, it is not an absolute requirement that the nucleic acid sequence to be introduced originates from the same plant species as the plant in which it will be introduced. It is sufficient that there is substantial homology between the endogenous target gene and the nucleic acid to be introduced.

Described above are examples of various methods for the reduction or substantial elimination of expression in a plant of an endogenous gene. A person skilled in the art would readily be able to adapt the aforementioned methods for silencing so as to achieve reduction of expression of an endogenous gene in a whole plant or in parts thereof through the use of an appropriate promoter, for example.

Transformation

The term "introduction" or "transformation" as referred to herein encompasses the transfer of an exogenous polynucleotide into a host cell, irrespective of the method used for transfer. Plant tissue capable of subsequent clonal propagation, whether by organogenesis or embryogenesis, may be transformed with a genetic construct of the present invention and a whole plant regenerated there from. The particular tissue chosen will vary depending on the clonal propagation systems available for, and best suited to, the particular species being transformed. Exemplary tissue targets include leaf disks, pollen, embryos, cotyledons, hypocotyls, megagametophytes, callus tissue, existing meristematic tissue (e.g., apical meristem, axillary buds, and root meristems), and induced meristem tissue (e.g., cotyledon meristem and hypocotyl meristem). The polynucleotide may be transiently or stably introduced into a host cell and may be maintained non-integrated, for example, as a plasmid. Alternatively, it may be integrated into the host genome. The resulting transformed plant cell may then be used to regenerate a transformed plant in a manner known to persons skilled in the art.

The transfer of foreign genes into the genome of a plant is called transformation. Transformation of plant species is now a fairly routine technique. Advantageously, any of several transformation methods may be used to introduce the gene of interest into a suitable ancestor cell. The methods described for the transformation and regeneration of plants from plant tissues or plant cells may be utilized for transient or for stable transformation. Transformation methods include the use of liposomes, electroporation, chemicals that increase free DNA uptake, injection of the DNA directly into the plant, particle gun bombardment, transformation using viruses or pollen and microprojection. Methods may be selected from the calcium/polyethylene glycol method for protoplasts (Krens, F. A. et al., (1982) Nature 296, 72-74; Negrutiu I et al. (1987) Plant Mol Biol 8: 363-373); electroporation of protoplasts (Shillito R. D. et al. (1985) Bio/Technol 3, 1099-1102); microinjection into plant material (Crossway A et al., (1986) Mol. Gen Genet 202: 179-185); DNA or RNA-coated particle bombardment (Klein T M et al., (1987) Nature 327: 70) infection with (non-integrative) viruses and the like. Transgenic plants, including transgenic crop plants, are preferably produced via *Agrobacterium*-mediated transformation. An advantageous transformation method is the transformation in planta. To this end, it is possible, for example, to allow the agrobacteria to act on plant seeds or to inoculate the plant meristem with agrobacteria. It has proved particularly expedient in accordance with the invention to allow a suspension of transformed agrobacteria to act on the intact plant or at least on the flower primordia. The plant is subsequently grown on until the seeds of the treated plant are obtained (Clough and Bent, Plant J. (1998) 16, 735-743). Methods for *Agrobacterium*-mediated transformation of rice include well known methods for rice transformation, such as those described in any of the following: European patent application EP 1198985 A1, Aldemita and Hodges (Planta 199: 612-617, 1996); Chan et al. (Plant Mol Biol 22 (3): 491-506, 1993), Hiei et al. (Plant J 6 (2): 271-282, 1994), which disclosures are incorporated by reference herein as if fully set forth. In the case of corn transformation, the preferred method is as described in either Ishida et al. (Nat. Biotechnol 14(6): 745-50, 1996) or Frame et al. (Plant Physiol 129(1): 13-22, 2002), which disclosures are incorporated by reference herein as if fully set forth. Said methods are further described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector, which is suitable for transforming *Agrobacterium tumefaciens*, for example pBin19 (Bevan et al., Nucl. Acids Res. 12 (1984) 8711). Agrobacteria transformed by such a vector can then be used in known manner for the transformation of plants, such as plants used as a model, like *Arabidopsis* (*Arabidopsis thaliana* is within the scope of the present invention not considered as a crop plant), or crop plants such as, by way of example, tobacco plants, for example by immersing bruised leaves or chopped leaves in an agrobacterial solution and then culturing them in suitable media. The transformation of plants by means of *Agrobacterium tumefaciens* is described, for example, by Höfgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

In addition to the transformation of somatic cells, which then have to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with agrobacteria and seeds are obtained from the developing plants of which a certain proportion is transformed and thus transgenic [Feldman, K A and Marks M D (1987). Mol Gen Genet 208:274-289; Feldmann K (1992). In: C Koncz, N-H Chua and J Shell, eds, Methods in *Arabidopsis* Research. Word Scientific, Singapore, pp. 274-289]. Alternative methods are based on the repeated removal of the inflorescences and incubation of the excision site in the center of the rosette with transformed agrobacteria, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension [Bechthold, N (1993). C R Acad Sci Paris Life Sci, 316: 1194-1199], while in the case of the "floral dip" method the developing floral tissue is incubated briefly with a surfactant-treated agrobacterial suspension [Clough, S J and Bent A F (1998) The Plant J. 16, 735-743]. A certain proportion of transgenic seeds are harvested in both cases, and these seeds can be distinguished from non-transgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process which has been schematically displayed in Klaus et al., 2004 [Nature Biotechnology 22 (2), 225-229]. Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview is given in Bock (2001) Transgenic plastids in basic research and plant biotechnology. J Mol Biol. 2001 Sep. 21; 312 (3):425-38 or Maliga, P (2003) Progress towards commercialization of plastid transformation technology. Trends Biotechnol. 21, 20-28. Further biotechnological progress has recently been reported in form of marker free plastid transformants, which can be produced by a transient co-integrated maker gene (Klaus et al., 2004, Nature Biotechnology 22(2), 225-229).

The genetically modified plant cells can be regenerated via all methods with which the skilled worker is familiar. Suitable methods can be found in the above-mentioned publications by S. D. Kung and R. Wu, Potrykus or Höfgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques. The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

T-DNA Activation Tagging

T-DNA activation tagging (Hayashi et al. Science (1992) 1350-1353), involves insertion of T-DNA, usually containing a promoter (may also be a translation enhancer or an intron), in the genomic region of the gene of interest or 10 kb up- or downstream of the coding region of a gene in a configuration such that the promoter directs expression of the targeted gene. Typically, regulation of expression of the targeted gene by its natural promoter is disrupted and the gene falls under the control of the newly introduced promoter. The promoter is typically embedded in a T-DNA. This T-DNA is randomly inserted into the plant genome, for example, through *Agrobacterium* infection and leads to modified expression of genes near the inserted T-DNA. The resulting transgenic plants show dominant phenotypes due to modified expression of genes close to the introduced promoter.

TILLING

The term "TILLING" is an abbreviation of "Targeted Induced Local Lesions In Genomes" and refers to a mutagenesis technology useful to generate and/or identify nucleic acids encoding proteins with modified expression and/or activity. TILLING also allows selection of plants carrying such mutant variants. These mutant variants may exhibit modified expression, either in strength or in location or in timing (if the mutations affect the promoter for example). These mutant variants may exhibit higher activity than that exhibited by the gene in its natural form. TILLING combines high-density mutagenesis with high-throughput screening methods. The steps typically followed in TILLING are: (a) EMS mutagenesis (Redei G P and Koncz C (1992) In Methods in *Arabidopsis Research, Koncz C, Chua N H, Schell J*, eds. Singapore, World Scientific Publishing Co, pp. 16-82; Feldmann et al., (1994) In Meyerowitz E M, Somerville CR, eds, *Arabidopsis*. Cold Spring Harbor Laboratory Press, Cold Spring Harbor, N.Y., pp 137-172; Lightner J and Caspar T (1998) In J Martinez-Zapater, J Salinas, eds, Methods on Molecular Biology, Vol. 82. Humana Press, Totowa, N.J., pp 91-104); (b) DNA preparation and pooling of individuals; (c) PCR amplification of a region of interest; (d) denaturation and annealing to allow formation of heteroduplexes; (e) DHPLC, where the presence of a heteroduplex in a pool is detected as an extra peak in the chromatogram; (f) identification of the mutant individual; and (g) sequencing of the mutant PCR product. Methods for TILLING are well known in the art (McCallum et al., (2000) Nat Biotechnol 18: 455-457; reviewed by Stemple (2004) Nat Rev Genet 5(2): 145-50).

Homologous Recombination

Homologous recombination allows introduction in a genome of a selected nucleic acid at a defined selected position. Homologous recombination is a standard technology used routinely in biological sciences for lower organisms such as yeast or the moss Physcomitrella. Methods for performing homologous recombination in plants have been described not only for model plants (Offring a et al. (1990) EMBO J 9(10): 3077-84) but also for crop plants, for example rice (Terada et al. (2002) Nat Biotech 20(10): 1030-4; lida and Terada (2004) Curr Opin Biotech 15(2): 132-8), and approaches exist that are generally applicable regardless of the target organism (Miller et al, Nature Biotechnol. 25, 778-785, 2007).

Yield Related Traits

Yield related traits comprise one or more of early flowering time; yield, biomass, seed yield, early vigour, greenness index, increased growth rate, improved agronomic traits such as improved Water Use Efficiency (WUE), Nitrogen Use Efficiency (NUE), etc.

Yield

The term "yield" in general means a measurable produce of economic value, typically related to a specified crop, to an area, and to a period of time. Individual plant parts directly contribute to yield based on their number, size and/or weight, or the actual yield is the yield per square meter for a crop and year, which is determined by dividing total production (includes both harvested and appraised production) by planted square meters. The term "yield" of a plant and "plant yield" are used interchangeably herein may relate to vegetative biomass such as root and/or shoot biomass, to reproductive organs, and/or to propagules such as seeds of that plant.

Taking corn as an example, a yield increase may be manifested as one or more of the following: increase in the number of plants established per square meter, an increase in the number of ears per plant, an increase in the number of rows, number of kernels per row, kernel weight, thousand kernel weight, ear length/diameter, increase in the seed filling rate (which is the number of filled seeds divided by the total number of seeds and multiplied by 100), among others. Taking rice as an example, a yield increase may manifest itself as an increase in one or more of the following: number of plants per square meter, number of panicles per plant, panicle length, number of spikelets per panicle, number of flowers (florets) per panicle, increase in the seed filling rate (which is the number of filled seeds divided by the total number of seeds and multiplied by 100), increase in thousand kernel weight, among others. In rice, submergence tolerance may also result in increased yield.

Early Flowering Time

Plants having an "early flowering time" as used herein are plants which start to flower earlier than control plants. Hence this term refers to plants that show an earlier start of flowering. Flowering time of plants can be assessed by counting the number of days ("time to flower") between sowing and the emergence of a first inflorescence. The "flowering time" of a plant can for instane be determined using the method as described in WO 2007/093444.

Early Vigour

"Early vigour" refers to active healthy well-balanced growth especially during early stages of plant growth, and may result from increased plant fitness due to, for example, the plants being better adapted to their environment (i.e. optimizing the use of energy resources and partitioning between shoot and root). Plants having early vigour also show increased seedling survival and a better establishment of the crop, which often results in highly uniform fields (with the crop growing in uniform manner, i.e. with the majority of plants reaching the various stages of development at substantially the same time), and often better and higher yield. Therefore, early vigour may be determined by measuring various factors, such as thousand kernel weight, percentage germination, percentage emergence, seedling growth, seedling height, root length, root and shoot biomass and many more.

Increased Growth Rate

The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced dry mature seeds, similar to the starting material. This life cycle may be influenced by factors such as speed of germination, early vigour, growth rate, greenness index, flowering time and speed of seed maturation. The increase in growth rate may take place at one or more stages in the life cycle of a plant or during substantially the whole plant life cycle. Increased growth rate during the early stages in the life cycle of a plant may reflect enhanced vigour. The increase in growth rate may alter the harvest cycle of a plant allowing plants to be sown later and/or harvested sooner than would otherwise be possible (a similar effect may be obtained with earlier flowering time). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soybean, potato or any other suitable plant). Harvesting additional times from the same rootstock in the case of some crop plants may also be possible. Altering the harvest cycle of a plant may lead to an increase in annual biomass production per square meter (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

Stress Resistance

An increase in yield and/or growth rate occurs whether the plant is under non-stress conditions or whether the plant is exposed to various stresses compared to control plants. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35%, 30% or 25%, more preferably less than 20% or 15% in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. Mild stresses are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures. The abiotic stress may be an osmotic stress caused by a water stress (particularly due to drought), salt stress, oxidative stress or an ionic stress. Biotic stresses are typically those stresses caused by pathogens, such as bacteria, viruses, fungi, nematodes and insects.

In particular, the methods of the present invention may be performed under non-stress conditions or under conditions of mild drought to give plants having increased yield relative to control plants. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signalling pathways and cellular responses, such as the production of stress proteins, up-regulation of anti-oxidants, accumulation of compatible solutes and growth arrest. The term "non-stress" conditions as used herein are those environmental conditions that allow optimal growth of plants. Persons skilled in the art are aware of normal soil conditions and climatic conditions for a given location. Plants with optimal growth conditions, (grown under non-stress conditions) typically yield in increasing order of preference at least 97%, 95%, 92%, 90%, 87%, 85%, 83%, 80%, 77% or 75% of the average production of such plant in a given environment. Average production may be calculated on harvest and/or season basis. Persons skilled in the art are aware of average yield productions of a crop.

Nutrient deficiency may result from a lack of nutrients such as nitrogen, phosphates and other phosphorous-containing compounds, potassium, calcium, magnesium, manganese, iron and boron, amongst others.

The term salt stress is not restricted to common salt (NaCl), but may be any one or more of: NaCl, KCl, LiCl, $MgCl_2$, $CaCl_2$, amongst others.

Increase/Improve/Enhance

The terms "increase", "improve" or "enhance" are interchangeable and shall mean in the sense of the application at least a 3%, 4%, 5%, 6%, 7%, 8%, 9% or 10%, preferably at least 15% or 20%, more preferably 25%, 30%, 35% or 40% more yield and/or growth in comparison to control plants as defined herein.

Seed Yield

Increased seed yield may manifest itself as one or more of the following:
a) an increase in seed biomass (total seed weight) which may be on an individual seed basis and/or per plant and/or per square meter;
b) increased number of flowers per plant;
c) increased number of seeds and/or increased number of filled seeds;
d) increased seed filling rate (which is expressed as the ratio between the number of filled seeds divided by the total number of seeds);
e) increased harvest index, which is expressed as a ratio of the yield of harvestable parts, such as seeds, divided by the total biomass, i.e. biomass of aboveground plant parts; and
f) increased thousand kernel weight (TKW), which is extrapolated from the number of filled seeds counted and their total weight.

An increased TKW may result from an increased seed size and/or seed weight, and may also result from an increase in embryo and/or endosperm size.

An increase in seed yield may also be manifested as an increase in seed size and/or seed volume. Furthermore, an increase in seed yield may also manifest itself as an increase in seed area and/or seed length and/or seed width and/or seed perimeter.

Greenness Index

The "greenness index" as used herein is calculated from digital images of plants. For each pixel belonging to the plant object on the image, the ratio of the green value versus the red value (in the RGB model for encoding color) is calculated. The greenness index is expressed as the percentage of pixels for which the green-to-red ratio exceeds a given threshold. Under normal growth conditions, under salt stress growth conditions, and under reduced nutrient availability growth conditions, the greenness index of plants is measured in the last imaging before flowering. In contrast, under drought stress growth conditions, the greenness index of plants is measured in the first imaging after drought.

Biomass

The term "biomass" as used herein is intended to refer to the total weight of a plant. Within the definition of biomass, a distinction may be made between the biomass of one or more parts of a plant, which may include:
aboveground (harvestable) parts such as but not limited to shoot biomass, seed biomass, leaf biomass, etc. and/or
(harvestable) parts below ground, such as but not limited to root biomass, etc., and/or
vegetative biomass such as root biomass, shoot biomass, etc., and/or
reproductive organs, and/or
propagules such as seed.

Marker Assisted Breeding

Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Use as Probes in (Gene Mapping)

Use of nucleic acids encoding the protein of interest for genetically and physically mapping the genes requires only a nucleic acid sequence of at least 15 nucleotides in length. These nucleic acids may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the nucleic acids encoding the protein of interest. The resulting banding patterns may then be subjected to genetic analyses using computer programs such as MapMaker (Lander et al. (1987) Genomics 1: 174-181) in order to construct a genetic map. In addition, the nucleic acids may be used to probe Southern blots containing restriction endonuclease-treated genomic DNAs of a set of individuals representing parent and progeny of a defined genetic cross. Segregation of the DNA polymorphisms is noted and used to calculate the position of the nucleic acid encoding the protein of interest in the genetic map previously obtained using this population (Botstein et al. (1980) Am. J. Hum. Genet. 32:314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridisation (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acids. Examples include allele-specific amplification (Kazazian (1989) J. Lab. Clin. Med 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al. (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

Plant

The term "plant" as used herein encompasses whole plants, ancestors and progeny of the plants and plant parts, including seeds, shoots, stems, leaves, roots (including tubers), flowers, and tissues and organs, wherein each of the aforementioned comprise the gene/nucleic acid of interest. The term "plant" also encompasses plant cells, suspension cultures, callus tissue, embryos, meristematic regions, gametophytes, sporophytes, pollen and microspores, again wherein each of the aforementioned comprises the gene/nucleic acid of interest.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs selected from the list comprising *Acer* spp., *Actinidia* spp., *Abelmoschus* spp., *Agave sisalana*, *Agropyron* spp., *Agrostis stolonifera*, *Allium* spp., *Amaranthus* spp., *Ammophila arenaria*, *Ananas comosus*, *Annona* spp., *Apium graveolens*, *Arachis* spp, *Artocarpus* spp., *Asparagus officinalis*, *Avena* spp. (e.g. *Avena sativa*, *Avena fatua*, *Avena byzantina*, *Avena fatua* var. *sativa*, *Avena hybrida*), *Averrhoa carambola*, *Bambusa* sp., *Benincasa hispida*, *Bertholletia excelsea*, *Beta vulgaris*, *Brassica* spp. (e.g. *Brassica napus*, *Brassica rapa* ssp. [canola, oilseed rape, turnip rape]), *Cadaba farinosa*, *Camellia sinensis*, *Canna indica*, *Cannabis sativa*, *Capsicum* spp., *Carex elata*, *Carica papaya*, *Carissa macrocarpa*, *Carya* spp., *Carthamus tinctorius*, *Castanea* spp., *Ceiba pentandra*, *Cichorium endivia*, *Cinnamomum* spp., *Citrullus lanatus*, *Citrus* spp., *Cocos* spp., *Coffea* spp., *Colocasia esculenta*, *Cola* spp., *Corchorus* sp., *Coriandrum sativum*, *Corylus* spp., *Crataegus* spp., *Crocus sativus*, *Cucurbita* spp., *Cucumis* spp., *Cynara* spp., *Daucus carota*, *Desmodium* spp., *Dimocarpus longan*, *Dioscorea* spp., *Diospyros* spp., *Echinochloa* spp., *Elaeis* (e.g. *Elaeis guineensis*, *Elaeis oleifera*), *Eleusine coracana*, *Eragrostis tef*, *Erianthus* sp., *Eriobotrya japonica*, *Eucalyptus* sp., *Eugenia uniflora*, *Fagopyrum* spp., *Fagus* spp., *Festuca arundinacea*, *Ficus carica*, *Fortunella* spp., *Fragaria* spp., *Ginkgo biloba*, *Glycine* spp. (e.g. *Glycine max*, *Soja hispida* or *Soja max*), *Gossypium hirsutum*, *Helianthus* spp. (e.g. *Helianthus annuus*), *Hemerocallis fulva*, *Hibiscus* spp., *Hordeum* spp. (e.g. *Hordeum vulgare*), *Ipomoea batatas*, *Juglans* spp., *Lactuca sativa*, *Lathyrus* spp., *Lens culinaris*, *Linum usitatissimum*, *Litchi chinensis*, *Lotus* spp., *Luffa acutangula*, *Lupinus* spp., *Luzula sylvatica*, *Lycopersicon* spp. (e.g. *Lycopersicon esculentum*, *Lycopersicon lycopersicum*, *Lycopersicon pyriforme*), *Macrotyloma* spp., *Malus* spp., *Malpighia emarginata*, *Mammea americana*, *Mangifera indica*, *Manihot* spp., *Manilkara zapota*, *Medicago sativa*, *Melilotus* spp., *Mentha* spp., *Miscanthus sinensis*, *Momordica* spp., *Morus nigra*, *Musa* spp., *Nicotiana* spp., *Olea* spp., *Opuntia* spp., *Ornithopus* spp., *Oryza* spp. (e.g. *Oryza sativa*, *Oryza latifolia*), *Panicum miliaceum*, *Panicum virgatum*, *Passiflora edulis*, *Pastinaca sativa*, *Pennisetum* sp., *Persea* spp., *Petroselinum crispum*, *Phalaris arundinacea*, *Phaseolus* spp., *Phleum pratense*, *Phoenix* spp., *Phragmites australis*, *Physalis* spp.,

*Pinus* spp., *Pistacia vera, Pisum* spp., *Poa* spp., *Populus* spp., *Prosopis* spp., *Prunus* spp., *Psidium* spp., *Punica granatum, Pyrus communis, Quercus* spp., *Raphanus sativus, Rheum rhabarbarum, Ribes* spp., *Ricinus communis, Rubus* spp., *Saccharum* spp., *Salix* sp., *Sambucus* spp., *Secale cereale, Sesamum* spp., *Sinapis* sp., *Solanum* spp. (e.g. *Solanum tuberosum, Solanum integrifolium* or *Solanum lycopersicum*), *Sorghum bicolor, Spinacia* spp., *Syzygium* spp., *Tagetes* spp., *Tamarindus indica, Theobroma cacao, Trifolium* spp., *Tripsacum dactyloides, Triticosecale rimpaui, Triticum* spp. (e.g. *Triticum aestivum, Triticum durum, Triticum turgidum, Triticum hybernum, Triticum macha, Triticum sativum, Triticum monococcum* or *Triticum vulgare*), *Tropaeolum minus, Tropaeolum majus, Vaccinium* spp., *Vicia* spp., *Vigna* spp., *Viola odorata, Vitis* spp., *Zea mays, Zizania palustris, Ziziphus* spp., amongst others.

Control Plant(s)

The choice of suitable control plants is a routine part of an experimental setup and may include corresponding wild type plants or corresponding plants without the gene of interest. The control plant is typically of the same plant species or even of the same variety as the plant to be assessed. The control plant may also be a nullizygote of the plant to be assessed. Nullizygotes are individuals missing the transgene by segregation. A "control plant" as used herein refers not only to whole plants, but also to plant parts, including seeds and seed parts.

DETAILED DESCRIPTION OF THE INVENTION

Surprisingly, it has now been found that modulating expression in a plant of a nucleic acid encoding an eRF1 polypeptide gives plants having enhanced yield-related traits relative to control plants. According to a first embodiment, the present invention provides a method for enhancing yield-related traits in plants relative to control plants, comprising modulating expression in a plant of a nucleic acid encoding an eRF1 polypeptide and optionally selecting for plants having enhanced yield-related traits.

The invention also provides hitherto unknown eRF1-encoding nucleic acids and eRF1 polypeptides.

According to a further embodiment of the present invention, there is therefore provided an isolated nucleic acid molecule selected from:

(i) a nucleic acid represented by any one of the following nucleic acid sequences: G.max_GM06MC33657_sm55b10@32878 having SEQ ID NO: 15; H.vulgare_c64960768hv270303@2598 having SEQ ID NO: 17;

(ii) the complement of a nucleic acid represented by said sequences: G.max_GM06MC33657_sm55b10@32878 having SEQ ID NO: 15; H.vulgare_c64960768hv270303@2598 having SEQ ID NO: 17;

(iii) a nucleic acid encoding the polypeptide as represented by any one G.max_GM06MC33657_sm55b10@32878 having SEQ ID NO: 16; H.vulgare_c64960768hv270303@2598 having SEQ ID NO: 18 preferably as a result of the degeneracy of the genetic code, said isolated nucleic acid can be derived from a polypeptide sequence as represented by any one of SEQ ID NO: 16 and 18 and further preferably confers enhanced yield-related traits relative to control plants;

(iv) a nucleic acid having, in increasing order of preference at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity with any of the nucleic acid sequences of Table A1 and further preferably conferring enhanced yield-related traits relative to control plants;

(v) a nucleic acid molecule which hybridizes with a nucleic acid molecule of (i) to (iv) under stringent hybridization conditions and preferably confers enhanced yield-related traits relative to control plants;

(vi) a nucleic acid encoding a eRF1 polypeptide having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 16 and 18 and any of the other amino acid sequences in Table A1 and preferably conferring enhanced yield-related traits relative to control plants.

According to a further embodiment of the present invention, there is also provided an isolated polypeptide selected from:

(i) an amino acid sequence represented by any one of SEQ ID NO: 16 and 18;

(ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 16 and 18 and any of the other amino acid sequences in Table A1 and preferably conferring enhanced yield-related traits relative to control plants.

(iii) derivatives of any of the amino acid sequences given in (i) or (ii) above.

Furthermore, it has now surprisingly been found that modulating expression in a plant of a nucleic acid encoding a SCAMP-like polypeptide gives plants having enhanced yield-related traits relative to control plants. According to a first embodiment, the present invention provides a method for enhancing yield-related traits in plants relative to control plants, comprising modulating expression in a plant of a nucleic acid encoding a SCAMP-like polypeptide and optionally selecting for plants having enhanced yield-related traits.

The invention also provides hitherto unknown SCAMP-like-encoding nucleic acids and polypeptides.

According to a further embodiment of the present invention, there is therefore provided an isolated nucleic acid molecule selected from:

(i) a nucleic acid represented by any one of SEQ ID NO: 100, 102, 104, 106, 180, 182, 184, 186, 188, 190 and 192;

(ii) the complement of a nucleic acid represented by any one of (i) SEQ ID NO: 100, 102, 104, 106, 108, 182, 184, 186, 188, 190 and 192;

(iii) a nucleic acid encoding the polypeptide as represented by any one of SEQ ID NO: 101, 103, 105, 107, 181, 183, 185, 187, 189, 191 and 193; preferably as a result of the degeneracy of the genetic code, said isolated nucleic acid can be derived from a polypeptide sequence as represented by any one of SEQ ID NO: 101, 103, 105, 107, 181, 183, 185, 187, 189, 191 and 193 and further preferably confers enhanced yield-related traits relative to control plants;

(iv) a nucleic acid having, in increasing order of preference at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity with any of the nucleic acid sequences of Table A2 and further preferably conferring enhanced yield-related traits relative to control plants;

(v) a nucleic acid molecule which hybridizes with a nucleic acid molecule of (i) to (iv) under stringent hybridization conditions and preferably confers enhanced yield-related traits relative to control plants;

(vi) a nucleic acid encoding a polypeptide having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 101, 103, 105, 107, 181, 183, 185, 187, 189, 191 and 193 and any of the other amino acid sequences in Table A2 and preferably conferring enhanced yield-related traits relative to control plants.

According to a further embodiment of the present invention, there is also provided an isolated polypeptide selected from:

(i) an amino acid sequence represented by any one of SEQ ID NO: 101, 103, 105, 107, 181, 183, 185, 187, 189, 191 and 193;

(ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 101, 103, 105, 107, 181, 183, 185, 187, 189, 191 and 193 and any of the other amino acid sequences in Table A2 and preferably conferring enhanced yield-related traits relative to control plants.

(iii) derivatives of any of the amino acid sequences given in (i) or (ii) above.

Furthermore, it has now surprisingly been found that modulating expression in a plant plastid of a nucleic acid encoding a fibrillin polypeptide gives plants having enhanced yield-related traits relative to control plants.

According to a first embodiment, the present invention provides a method for enhancing yield-related traits in plants relative to control plants, comprising modulating expression in a plant plastid of a nucleic acid encoding a fibrillin polypeptide and optionally selecting for plants having enhanced yield-related traits.

According to a further embodiment of the present invention, there is therefore provided an isolated nucleic acid molecule selected from:

(i) a nucleic acid represented by any one of the following nucleic acid sequences: B.napus_BN06MC20042_46499279@19975 having SEQ ID NO: 206; G.max_GMO6MC19234_59694709@18873 having SEQ ID NO: 220;

(ii) the complement of a nucleic acid represented by said sequences B.napus_BN06MC20042_46499279@19975 having SEQ ID NO: 206; G.max_GM06MC19234_59694709@18873 having SEQ ID NO 220;

(iii) a nucleic acid encoding the polypeptide as represented by any one SEQ ID NO: 207; SEQ ID NO 221 preferably as a result of the degeneracy of the genetic code, said isolated nucleic acid can be derived from a polypeptide sequence as represented by any one of SEQ ID NO: 207 and 221 and further preferably confers enhanced yield-related traits relative to control plants;

(iv) a nucleic acid having, in increasing order of preference at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity with any of the nucleic acid sequences of Table A3 and further preferably conferring enhanced yield-related traits relative to control plants;

(v) a nucleic acid molecule which hybridizes with a nucleic acid molecule of (i) to (iv) under stringent hybridization conditions and preferably confers enhanced yield-related traits relative to control plants;

(vi) a nucleic acid encoding a fibrillin polypeptide having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 207, and 221 and any of the other amino acid sequences in Table A3 and preferably conferring enhanced yield-related traits relative to control plants.

According to a further embodiment of the present invention, there is also provided an isolated polypeptide selected from:

(i) an amino acid sequence represented by any one of SEQ ID NO: 207 and 221;

(ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 207 and 221 and any of the other amino acid sequences in Table A3 and preferably conferring enhanced yield-related traits relative to control plants.

(iii) derivatives of any of the amino acid sequences given in (i) or (ii) above.

Furthermore, it has now surprisingly been found that modulating expression in a plant of a nucleic acid encoding a PLATZ polypeptide gives plants having enhanced yield-related traits relative to control plants. According to a first embodiment, the present invention provides a method for enhancing yield-related traits in plants relative to control plants, comprising modulating expression in a plant of a nucleic acid encoding a PLATZ polypeptide and optionally selecting for plants having enhanced yield-related traits.

The invention also provides hitherto unknown PLATZ-encoding nucleic acids and PLATZ polypeptides.

According to a further embodiment of the present invention, there is therefore provided an isolated nucleic acid molecule selected from:
  (i) a nucleic acid represented by SEQ ID NO: 354;
  (ii) the complement of a nucleic acid represented by SEQ ID NO: 354;
  (iii) a nucleic acid encoding a PLATZ polypeptide having, in increasing order of preference, at least 50%, 55%, 60%, 65%, 70%, 75%, 80%, 85%, 90%, 95%, 96%, 97%, 98%, 99% or more sequence identity to the amino acid sequence represented by SEQ ID NO: 355, and having in increasing order of preference at least 50%, 55%, 60%, 65%, 70%, 75%, 80%, 85%, 90%, 95%, 96%, 97%, 98%, 99% or more sequence identity to one or more of the motifs as defined herein.

According to a further embodiment of the present invention, there is also provided an isolated polypeptide selected from:
  (i) an amino acid sequence represented by SEQ ID NO: 355;
  (ii) an amino acid sequence having, in increasing order of preference, at least 50%, 55%, 60%, 65%, 70%, 75%, 80%, 85%, 90%, 95%, 96%, 97%, 98%, 99% or more sequence identity to the amino acid sequence represented by SEQ ID NO: 355, and having in increasing order of preference at least 50%, 55%, 60%, 65%, 70%, 75%, 80%, 85%, 90%, 95%, 96%, 97%, 98%, 99% or more sequence identity to one or more of the motifs as defined herein;
  (iii) derivatives of any of the amino acid sequences given in (i) or (ii) above.

Furthermore, it has now surprisingly been found that modulating expression in a plant of a nucleic acid encoding a PLST-like polypeptide gives plants having enhanced yield-related traits relative to control plants. According to a first embodiment, the present invention provides a method for enhancing yield-related traits in plants relative to control plants, comprising modulating expression in a plant of a nucleic acid encoding a PLST-like polypeptide and optionally selecting for plants having enhanced yield-related traits.

The invention also provides hitherto unknown PLST-like-encoding nucleic acids and PLST-like polypeptides.

According to a further embodiment of the present invention, there is therefore provided an isolated nucleic acid molecule selected from:
  (i) a nucleic acid represented by any one of the following nucleic acid sequences: having SEQ ID NO: 414; SEQ ID NO: 426; SEQ ID NO: 428; SEQ ID NO: 434; SEQ ID NO: 438;
  (ii) the complement of a nucleic acid represented by said sequences having SEQ ID NO: 414; SEQ ID NO: 426; SEQ ID NO: 428; SEQ ID NO: 434; SEQ ID NO: 438;
  (iii) a nucleic acid encoding the polypeptide as represented by any one having SEQ ID NO: 415; SEQ ID NO: 427; SEQ ID NO: 429; SEQ ID NO: 435; SEQ ID NO: 439 preferably as a result of the degeneracy of the genetic code, said isolated nucleic acid can be derived from a polypeptide sequence as represented by any one of SEQ ID NO: 415; SEQ ID NO: 427; SEQ ID NO: 429; SEQ ID NO: 435; SEQ ID NO: 439: and further preferably confers enhanced yield-related traits relative to control plants;
  (iv) a nucleic acid having, in increasing order of preference at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity with any of the nucleic acid sequences of Table A5 and further preferably conferring enhanced yield-related traits relative to control plants;
  (v) a nucleic acid molecule which hybridizes with a nucleic acid molecule of (i) to (iv) under stringent hybridization conditions and preferably confers enhanced yield-related traits relative to control plants;
  (vi) a nucleic acid encoding a PLST-like polypeptide having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 415; SEQ ID NO: 427; SEQ ID NO: 429; SEQ ID NO: 435; SEQ ID NO: 439: and any of the other amino acid sequences in Table A5 and preferably comprising the motifs 19 to 21 and 44 to 60 and the PF domain, conferring enhanced yield-related traits relative to control plants.

According to a further embodiment of the present invention, there is also provided an isolated polypeptide selected from:
  (i) an amino acid sequence represented by any one of SEQ ID NO: 415; SEQ ID NO: 427; SEQ ID NO: 429; SEQ ID NO: 435; SEQ ID NO: 439;
  (ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 415; SEQ ID NO: 427; SEQ ID NO: 429; SEQ ID NO: 435; SEQ ID NO: 439; and any of the other amino acid sequences in Table A5 and preferably comprising the motifs 19 to 21 and 44 to 60 and the PF domain, conferring enhanced yield-related traits relative to control plants.
  (iii) derivatives of any of the amino acid sequences given in (i) or (ii) above.

Furthermore, it has now surprisingly been found that modulating expression in a plant of a nucleic acid encoding a Glomalin polypeptide gives plants having enhanced yield-related traits relative to control plants. According to a first embodiment, the present invention provides a method for enhancing yield-related traits in plants relative to control plants, comprising modulating expression in a plant of a nucleic acid encoding a Glomalin polypeptide and optionally selecting for plants having enhanced yield-related traits.

The invention also provides hitherto unknown Glomalin-encoding nucleic acids and Glomalin polypeptides.

According to a further embodiment of the present invention, there is therefore provided an isolated nucleic acid molecule selected from:
  (i) a nucleic acid represented by any of SEQ ID NO: 568, SEQ ID NO: 569, or SEQ ID NO: 570;
  (ii) the complement of a nucleic acid represented by any of SEQ ID NO: 568, SEQ ID NO: 569, or SEQ ID NO: 570;
  (iii) a nucleic acid encoding a Glomalin polypeptide having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any of SEQ ID NO: 592, SEQ ID NO: 593, or SEQ ID NO: 594, and additionally or alternatively comprising one or more motifs having in increasing order of preference two, one or no sequence mismatch compared to any of the Motifs 31 to 43 (SEQ ID NO: 596 to SEQ ID NO: 608), and further preferably conferring enhanced yield-related traits relative to control plants.
  (iv) a nucleic acid molecule which hybridizes with a nucleic acid molecule of (i) to (iii) under high stringency hybridization conditions and preferably confers enhanced yield-related traits relative to control plants.

According to a further embodiment of the present invention, there is also provided an isolated polypeptide selected from:
  (i) an amino acid sequence represented by any of SEQ ID NO: 592, SEQ ID NO: 593, or SEQ ID NO: 594;
  (ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any of SEQ ID NO: 592, SEQ ID NO: 593, or SEQ ID NO: 594, and additionally or alternatively comprising one or more motifs having in increasing order of preference two, one or no sequence mismatch compared to any of the motifs 41 to 43 (SEQ ID NO: 596 to SEQ ID NO: 608), and further preferably conferring enhanced yield-related traits relative to control plants;
  (iii) derivatives of any of the amino acid sequences given in (i) or (ii) above.

A preferred method for modulating, and preferably increasing, expression of a nucleic acid encoding an eRF1 polypeptideis by introducing and expressing in a plant a nucleic acid encoding an eRF1 polypeptide. Another preferred method for modulating, preferably increasing, expression of a nucleic acid encoding a SCAMP-like polypeptide is by introducing and expressing in a plant a nucleic acid encoding a SCAMP-like polypeptide. Yet another preferred method for modulating, preferably increasing, expression of a nucleic acid encoding a fibrillin polypeptide is by introducing and expressing in a plant a nucleic acid encoding a fibrillin polypeptide. Another preferred method for modulating, preferably increasing, expression of a nucleic acid encoding a PLATZ polypeptide is by introducing and expressing in a plant a nucleic acid encoding a PLATZ polypeptide. Still another preferred method for modulating, preferably increasing, expression of a nucleic acid encoding a PLST-like polypeptide is by introducing and expressing in a plant a nucleic acid encoding a PLST-like polypeptide. Another preferred method for modulating, preferably increasing, expression of a nucleic acid encoding a Glomalin polypeptide is by introducing and expressing in a plant a nucleic acid encoding a Glomalin polypeptide.

In one embodiment, a "protein useful in the methods of the invention" is taken to mean an eRF1 polypeptide as defined herein. In another embodiment, a "nucleic acid useful in the methods of the invention" is taken to mean a nucleic acid capable of encoding such an eRF1 polypeptide. A nucleic acid to be introduced into a plant, and therefore useful in performing the methods of the invention, is in such embodiment any nucleic acid encoding the type of protein which will now be described, hereafter also named "eRF1 nucleic acid" or "eRF1 gene".

The "eRF1 polypeptide" as defined herein refers to any polypeptide comprising at least tree consensus domains—eRF1 domain 1, eRF1 domain 2 and eRF1 domain 3, with PFam accession numbers respectively PF03463, PF03464 and PF03465.

Preferably, the eRF1 domain 1 of an eRF1 polypeptide has at least, in increasing order of preference, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the sequence located between amino acid 6 and 140 of SEQ ID NO 2.

Preferably, the eRF1 domain 2 of an eRF1 polypeptide has at least, in increasing order of preference, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the sequence located between amino acid 144 and 278 of SEQ ID NO 2. Preferably, the eRF1 domain 3 of an eRF1 polypeptide has at least, in increasing order of preference, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the sequence located between amino acid 281 and 418 of SEQ ID NO 2.

Further preferable the eRF1 polypeptide of the present invention comprises one or more of the following peptides: GGQ, NIKS and [GA][IMLV]LR[YW] having SEQ ID NO: 73, 74 and 75 respectively.

Alternatively, the eRF1 polypeptide useful in the methods of the invention comprises one or more sequence motifs having at least, in increasing order of preference 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to anyone of the following motifs:

The amino acids as indicated herein in brackets represent a possible replacement by any other amino acid.

Motif 1:
(SEQ ID NO: 76)
FGTLSGNTREVLHKF[TS]VDLPKKHGR<u>GGQ</u>SALRFARLRMEKRHNYVRK[TV]AE;

Motif 2:
(SEQ ID NO: 77)
YN[KR]VPPNGLVLY[TC]GT[IV]VT[ED][DE]GKEKKV[TN]IDFEPF[KR]PIN[AT]SLYLCD

NKFHTE;

Motif 3:
(SEQ ID NO: 78)
ARGNGTSMISLI[MI]PP[RK]DQ[IV]SRVTKML[GA]DE[YF]GTAS<u>NIKS</u>RVNR[QL]SV

L[GS]AIT.

Motifs 1 to 3 are typically found in any eRF1 polypeptide.

In another preferred embodiment of the present invention the eRF1 polypeptide of the invention may comprise any one or more sequence motifs having at least, in increasing order of preference 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to anyone of the following motifs:

Motif 4:
(SEQ ID NO: 79)
F[TS]VDLPKKHGR<u>GGQ</u>SALRFARLR[EM]EKRHNYVRKVAE[VL]A[VT]QNFITND

[KR][PV]NV;

Motif 5:
(SEQ ID NO: 80)
Y[NT][KR]VPPNGLV[VLI]YCG[TD][IV][ILM]T[ED][ED]GKE[KR]K[VM][NT]ID[FI]E

PFKPINTSLYLCDNKFHTE;

Motif 6:
(SEQ ID NO: 81)
ARGNGTSMISL[IV][IM]PPK[DG]Q[IV]S[RL]V[QA]KML[AT][DE]EYGTAS<u>NIKS</u>RVN

R[LQ]SVL[SG]AIT.

Motifs 4, 5 and 6 correspond to a consensus sequences which represent conserved protein regions in an eRF1 polypeptide of non-Streptophyta origin.

Most preferably, the eRF1 polypeptide of the invention may comprise any one or more of the following sequence motifs having at least, in increasing order of preference 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to anyone of the following motifs:

Motif 7:
(SEQ ID NO: 82)
VDLPKKHGR<u>GGQ</u>SALRFARLRMEKRHNYVRKTAELATQF[YF]INPATS

QPNV

Motif 8:
(SEQ ID NO: 83)
YNKVPPNGLVLYTGTIVT[ED]DGKEKKVTIDFEPF[KR]PINASLYLC

DNKFHTE

Motif 9:
(SEQ ID NO: 84)
TSMISLIMPPRDQ[VI]SRVTKMLGDE[FY]GTAS<u>NIKS</u>RVNRQSVLGA

ITSAQQR

Motifs 7, 8 and 9 correspond to a consensus sequences which represent conserved protein regions in an eRF1 polypeptide of *Streptophyta* cluster to which *Arabidopsis* belongs.

It is understood that Motif 1, 2, 3, 4, 5, 6, 7, 8 and 9 as referred herein represent the consensus sequence of the homologous motifs as present in a specific eRF1 polypeptide, preferably in any eRF1 polypeptide of Table A1, more preferably in SEQ ID NO: 2. Motifs as defined herein are not limited to their respective sequence but they encompass the homologous motifs as present in any eRF1.

Methods to identify homologous motif to Motifs 1 to 9 in a polypeptide useful in the methods of the present invention are well known in the art. For example the polypeptide may be compared to the motif by aligning their respective amino acid sequence to identify regions with similar sequence using an algorithm such as Blast (Altschul et al. (1990) J Mol Biol 215: 403-10).

Alternatively, the homologue of eRF1 polypeptide has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by any of the polypeptides of Table A1, preferably by the SEQ ID NO: 2, provided that the homolog polypeptide comprises the conserved motifs as outlined above. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered. For local alignments, the Smith-Waterman algorithm is particularly useful (Smith T F, Waterman M S (1981) J. Mol. Biol 147(1); 195-7).

Preferably, the sequences of eRF1 polypeptides, when used in the construction of a phylogenetic tree, such as the one depicted in FIG. 1, clusters with the group of eRF1 polypeptides comprising the amino acid sequences represented by SEQ ID NO: 2.

In another embodiment, a "protein/polypeptide useful in the methods of the invention" is taken to mean a SCAMP-like polypeptide as defined herein. In another embodiment a "nucleic acid useful in the methods of the invention" is taken to mean a nucleic acid capable of encoding such a SCAMP-like polypeptide. A nucleic acid to be introduced into a plant, and therefore useful in performing the methods of the invention, is in such embodiment any nucleic acid encoding the type of protein which will now be described, hereafter also named "SCAMP-like nucleic acid" or "SCAMP-like gene".

A "SCAMP-like polypeptide" as defined herein refers to any polypeptide comprising a SCAMP domain (HMM PFam PF04144).

Preferably the SCAMP domain of a SCAMP-like polypeptide has in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to the amino acid of the SCAMP domain present in any of the polypeptides of Table A2, preferably to the SCAMP domain represented by the sequence located between amino acids 91 and 265 of SEQ ID NO: 89.

More preferably and in addition to the SCAMP domain, the SCAMP-like polypeptide useful in the methods of the invention has one or more, preferably and at least 4, or 3, or 2, or 1 transmembrane domain regions (TMRs).

Transmembrane domain regions (TMRs) in a polypeptide and methods to identify the same are well known in the art. Examples of such methods are further provided in the Example section.

More preferably the TMR of a SCAMP-like polypeptide useful in the methods of the invention has in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to the amino acid of one or more of the TMRs present in any of the polypeptides of Table A2, preferably of SEQ ID NO: 89.

The TMRs as present in SEQ ID NO: 89 are represented by the following sequences:

| N-terminal | transmembrane region | C-terminal | length | SEQ ID NO: |
|---|---|---|---|---|
| 121 | AFTTLLGLVGCLLWNIVAVTVAW | 143 | 23 | 194 |
| 151 | IWLLSIIYFLAGVPGAYVLWYRP | 173 | 23 | 195 |
| 186 | FGAFFFFYVFHIAFCGFAAVAPP | 208 | 23 | 196 |
| 227 | TTNAAVGIMYFIGAGFFCIETLL | 249 | 23 | 197 |

The N-terminal and C-terminal columns indicate the amino acid coordinates of the transmembrane domain in SEQ ID NO: 89

Further more preferably the SCAMP-like polypeptide useful in the methods of the invention comprises at least 2, 1, 0, 3, 4 or 5 repeats or the tripeptide NPF (SEQ ID NO: 198). This tripeptide has been associated with the biological role of SCAMP proteins to recruit by binding EH-proteins during endocytosis. The NPF tripeptide in a SCAMP polypeptide are preferably located in increasing order of preference at the N-terminus, the C-terminus and at both the N- and the C-terminus.

Typically and even more preferably the SCAMP-like polypeptides of the invention share a common domain structure composed of a cytoplasmic N-terminal domain with multiple NPF repeats, four highly conserved transmembranes regions (TMRs), and a short cytoplasmic C-terminal tail.

The N-terminal tail of a preferred SCAMP-like polypeptide of the invention has in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid of the N-terminal tail as present in any of the polypeptides of Table A2, preferably of SEQ ID NO: 89 and represented by MARHDPNPFADEEINPFANHTSVPPASNSYLKPLPPEPYDRGATVDIPLDSGNDLRAKEM ELQAKENELKRKEQELKRREDAIARTGVVIEEKNWPEFFPLIHHDIP NEIPIHLQKIQYV (SEQ ID NO: 199).

The C-terminal tail of a preferred SCAMP-like polypeptide of the invention has in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid of the C-terminal tail as present in any of the polypeptides of Table A2, preferably of SEQ ID NO: 89 and represented by NIWVIQQVYAYFRGSGKAAEMKREA TKSTLMRAL (SEQ ID NO: 200).

Typically polypeptides comprise an E peptide. An E peptide refers to a conserved amino acid motif, having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% overall sequence identity to the amino acid represented LWYRPLYRAFRTDSA (SEQ ID NO: 201) or LWYRPLYNAMRTESA (SEQ ID NO: 202).

Alternatively, a SCAMP-like nucleic acid of the invention is any nucleic acid encoding a homologue of any of the polypeptides of Table A2, preferably a paralogue or an orthologue thereof. Preferably such homologue has an equivalent (or similar) biological function, for example recruiting EH-proteins during endocytosis processes occurring at cell separation, for example during fruit abscission and dehiscence.

Alternatively, the homologue of a SCAMP-like protein useful in the methods of the invention has in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% overall sequence identity to the amino acid represented by any of the polypeptides of Table A2, preferably to SEQ ID NO: 89.

The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered. For local alignments, the Smith-Waterman algorithm is particularly useful (Smith T F, Waterman M S (1981) J. Mol. Biol 147(1); 195-7).

In another embodiment, a "protein useful in the methods of the invention" is taken to mean a fibrillin polypeptide as defined herein. In another embodiment, a "nucleic acid useful in the methods of the invention" is taken to mean a nucleic acid capable of encoding such a fibrillin polypeptide. A nucleic acid to be introduced into a plant, and therefore useful in performing the methods of the invention, in such embodiment is any nucleic acid encoding the type of protein which will now be described, hereafter also named "fibrillin nucleic acid" or "fibrillin gene".

A "fibrillin polypeptide" as defined herein refers to any polypeptide comprising the following
- (i) a PAP fibrillin domain as represented by PFAM Accession number PF04755; and
- (ii) a C-terminal domain represented by KFECQNESRG-GLVRNVIKWSVPRLLEEN EGATLIVTARFSS-VSARNIYLKFEEIGLQNINISDDLQAVIAPAILPRS-FLSLQILQF IRSFKARVPVTSPERHSVGGLYYLSYLDKNMLL-GRAVGGGGVFIFTRAHTL (SEQ ID NO: 253) which may contain between 0 and 5 gaps representing between 1 and 15 residues, or a domain having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to (SEQ ID NO: 253); and optionally
- (iii) a transit peptide within the N-terminal region of the polypeptide.

SEQ ID NO: 253 represents the amino acid sequence of the C-terminal domain as it appears in the fibrillin represented by SEQ ID NO: 205.

According to a preferred feature of the present invention, the PAP fibrillin domain is represented by: ENRKYELLNI-IQDTQRGLVTTADQRSTIEEAMVVVEGFDAGKEIDL-SKL DG TWQYTSAPDVLILFESAARLPFFQVGQIFQ (SEQ ID NO: 252) which may contain between 0 and 5 gaps representing between 1 and 15 residues, or a domain having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to SEQ ID NO: 252. SEQ ID NO: 252 represents the amino acid sequence of the PAP fibrillin domain as it appears in the fibrillin represented by SEQ ID NO: 205.

A further feature of fibrillin poypeptides is the presence of one or more of the following domains:
Domain X: NIYLQF[EQ]E[IA]S[VL]Q[ND]INISE[EQ]LQAL[IL]APA[IL]LPRSFL[SN]LQILQ[FA][LI][RK][TS]F[KR]AQ[VI]P (SEQ ID NO: 254);
Domain Y: YYL[ST]YLD[RN][ND]MLLGR[AS]VGGGGV (SEQ ID NO: 255);
Domain Z: [PA][IL]DL[AS]KLDGTWRLQYTSA[SP]DV (SEQ ID NO: 256); or a domain having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to any one or more of Domains X, Y and Z.

Fibrillin poylpeptides typically have in increasing order of preference at least 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or more overall sequence identity to the amino acid represented by SEQ ID NO: 205. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered. For local alignments, the Smith-Waterman algorithm is particularly useful (Smith T F, Waterman M S (1981) J. Mol. Biol 147(1); 195-7).

Preferably, the polypeptide sequence which when used in the construction of a phylogenetic tree, such as the one depicted in FIG. 6, clusters with the group of fibrillin polypeptides comprising the amino acid sequence represented by SEQ ID NO: 205 rather than with any other group.

In another embodiment, a "protein useful in the methods of the invention" is taken to mean a PLATZ polypeptide as defined herein. In another embodiment, a "nucleic acid useful in the methods of the invention" is taken to mean a nucleic acid capable of encoding such a PLATZ polypeptide. A nucleic acid to be introduced into a plant, and therefore useful in performing the methods of the invention, is in such embodiment any nucleic acid encoding the type of protein which will now be described, hereafter also named "PLATZ nucleic acid" or "PLATZ gene".

A "PLATZ polypeptide" as defined herein refers to any polypeptide comprising a PLATZ domain (Pfam accession PF04640; InterPro accession IPR006734); and comprising an N-terminal zinc binding region with the consensus sequence $C-x_{(2)}-H-x_{(11)-C-x}(2)-C-x_{(4-5)}-C-x_{(2)}-C-x_{(3-7)}-H-x_{(2)}-H$ (SEQ ID NO: 262) and a zinc binding region with the consensus sequence $C-x_{(2)}-C-x_{(10-11)}-C-x_{(3)}-C$ (SEQ ID NO: 263) in the central region, as described in Nagano et al. (2001). In other words, a "PLATZ polypeptide" as defined herein refers to any polypeptide comprising a PLATZ domain (Pfam accession PF04640; InterPro accession IPR006734); and comprising an N-terminal zinc binding region with a consensus sequence as given by any of the following sequences: CxxHxxxxxxxxxxCxxCxxxxCxx-CxxxHxxH (SEQ ID NO: 645); CxxHxxxxxxxxxxx Cxx-CxxxxCxxCxxxxxHxxH (SEQ ID NO: 646); Cxx-HxxxxxxxxxxxxCxxCxxxxCxxCxxxxxHxxH (SEQ ID NO: 647); CxxHxxxxxxxxxxxCxxCxxxxCxxCxxxxxxHxxH (SEQ ID NO: 648); CxxHxxxxxxxxxxxCxxCxxxxCxx-CxxxxxxxHxxH (SEQ ID NO: 649); CxxHxxxxxxxxxxx-Cxx CxxxxCxxCxxxHxxH (SEQ ID NO: 650); Cxx-HxxxxxxxxxxxxCxxCxxxxCxxCxxxxHxxH (SEQ ID NO: 651); CxxHxxxxxxxxxxxCxxCxxxxCxxCxxxxxHxxH (SEQ ID NO: 652); CxxHxxxxxxxxxxxCxxCxxxxCxx-CxxxxxxxHxxH (SEQ ID NO: 653); CxxHxxxxxxxxxxx CxxCxxxxCxxCxxxxxxxHxxH (SEQ ID NO: 654); and a zinc binding region with the consensus sequence Cxx-CxxxxxxxxxxCxxxC (SEQ ID NO: 655) or Cxx-Cxxxxxxxxxxx CxxxC (SEQ ID NO: 656) in the central region, as described in Nagano et al. (2001).

Preferably, the PLATZ protein useful in the methods of the present invention comprises one or more of the following motifs (defined by MEME; Bailey and Elkan, Proceedings of the Second International Conference on Intelligent Systems for Molecular Biology, pp. 28-36, AAAI Press, Menlo Park, Calif., 1994, Bailey et al., Nucleic Acids Research, 34, W369-W373, 2006):

Motif 10 (SEQ ID NO: 264): [VI]QTY[TVI]INSA[KR]V [VI]FL[NK][QE]RPQ[SP]R

Motif 11 (SEQ ID NO: 265): HRSHR[LV][LI]Q[VI]RR [YS][VS]YHDV[VI]R[LV]x[DE][LI][QE]KL[IL]D[CI]

Motif 12 (SEQ ID NO: 266): [KR]NE[KC]N[IV]FCLDC

More preferably, the PLATZ proteins comprise one or more of the following motifs, as defined by MEME:

Motif 13 (SEQ ID NO: 267): HRSH[RP]LLQVRRYVYH-DV[VI]RLEDL[EQ]KLIDCS

Motif 14 (SEQ ID NO: 268): FKG[SL]GN[SY]CT[TS]CDR [SI]LQEP[FY][HR][FHY]CS[LV] [SG]CKV Motif 15 (SEQ ID NO: 269): AWLE[AG]L[LY][TA][EDQ] KFFV[GA]C[SP]xHEx[AR][KR]KNE KN[IV][FC]C [LV]DC[CS][AT]SIC[PQ]HC Most preferably, the PLATZ proteins comprise one or more of the following motifs, as defined by MEME:

Motif 16 (SEQ ID NO: 270): RRYVYHDVVRLEDL[EQ] KLIDCS[NS]VQ[AS]YTINS[AS]KV VF[IL]KKRPQN-RQFKG[SA]GN Motif 17 (SEQ ID NO: 271): PAWLEALY[TA][QE]KFF [VA][GA]CS[YF]HE[HNT]AKKNEKN [IV]CCLDCC [TI]SICPHC[VL]P[SA]HR[FV]HR Motif 18 (SEQ ID NO: 272): CTSCDRSLQEP[FY][IF] HCSL[GD]CKV[DE][FY][VI]L[KR][HQ] [YK]KDLS [PA]YLR[PTR]C[KN][TS]L[QT]L[GS]PDF[FL]IP Furthermore preferably, the PLATZ polypeptide comprises in increasing order of preference, at least 2 or at least 3 of the motifs listed above.

Alternatively or additionally, the homologue of a PLATZ protein has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 261, provided that the homologous protein comprises one or more of the conserved motifs as outlined above. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered. Preferably the motifs in a PLATZ polypeptide have, in increasing order of preference, at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the motifs represented by SEQ ID NO: 264 to SEQ ID NO: 272 (Motifs 10 to 18).

Preferably, the polypeptide sequence which when used in the construction of a phylogenetic tree, such as the one depicted in FIG. 12, clusters with the group of PLATZ-A polypeptides, more preferably with the group of PLATZ-A1 proteins, most preferably with the group of PLATZ-A1-α proteins, comprising the amino acid sequence represented by SEQ ID NO: 261 rather than with any other group of PLATZ proteins.

In another embodiment, a "protein useful in the methods of the invention" is taken to mean a PLST-like polypeptide as defined herein. In another embodiment, a "nucleic acid useful in the methods of the invention" is taken to mean a nucleic acid capable of encoding such a PLST-like polypeptide. A nucleic acid to be introduced into a plant, and therefore useful in performing the methods of the invention, is in such embodiment any nucleic acid encoding the type of protein which will now be described, hereafter also named "PLST-like nucleic acid" or "PLST-like gene".

The "PLST-like polypeptide" as defined herein refers to any polypeptide comprising at least a PLST-like consensus domain—with PFam accession number PF02298.

Preferably, the PLST-like domain of a PLST-like polypeptide has at least, in increasing order of preference, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the sequence located between amino acid 38 and 124 of SEQ ID NO 411.

Alternatively, the PLST-like polypeptide useful in the methods of the invention comprises one or more sequence motifs having at least, in increasing order of preference 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to anyone of the following motifs:

Motif 19: [DH]SV[LI]QV[TS]KE[DA][YF][DK]SCNT [SK][NSD]P (SEQ ID NO: 530);

Motif 20: [FHY]YF[IT]SGV[PK][GD][HN]C (SEQ ID NO: 531);

Motif 21: Y[NT][QK]WA[ESK][KS]NRF[KQ][IV]GD[ST] [LI][VL]F[KL]YP (SEQ ID NO: 532);

Motif 44: [DHN][SND][VLM]xx[VL]xxxx[FYHN]xxCxx-Tx[NSD] (SEQ ID NO: 615);

Motif 45: [GD]xx[FY][FYI]x[SGC][GAIT] (SEQ ID NO: 616); and preferably said x in position 3 is selected from the following amino acids: F, H, Y, V, and A.

Motif 46:
(SEQ ID NO: 617)
[GV][GDAE]xxxWx[VITLA]xxxxxxW[ASPV]xxxx[FL]xx[GDNS]Dxxxxx[FY];

Motif 47:
(SEQ ID NO: 618)
[GV][GDAE]xxxWx[VITLA]xxxxxxxW[ASPV]xxxx[FL]xx[GDNS]Dxxxxx[FY];

Motif 48:
(SEQ ID NO: 619)
[GV][GDAE]xxxWx[VITLA]xxxxxxxxW[ASPV]xxxx[FL]xx[GDNS]Dxxxxx[FY];

Motif 49:
(SEQ ID NO: 620)
[GV][GDAE[xxxWx[VITLA]xxxxxxxxxW[ASPV]xxxx[FL]xx[GDNS]Dxxxxx[FY];

Motif 50:
(SEQ ID NO: 621)
[GV][GDAE]xxxWx[VITLA]xxxxxxxxxxW[ASPV]xxxx[FL]xx[GDNS]Dxxxxx[FY];

Motif 51
(SEQ ID NO: 622)
[GV][GDAE]xxxWx[VITLA]xxxxxxxxxxxW[ASPV]xxxx[FL]xx[GDNS]Dxxxxx[FY];

Motif 52:
(SEQ ID NO: 623)
[GV][GDAE]xxxWx[VITLA]xxxxxxxxxxxxW[ASPV]xxxx[FL]xx[GDNS]Dxxxxx[FY];

Motif 53:
(SEQ ID NO: 624)
[GV][GDAE]xxxxWx[VITLA]xxxxxxxW[ASPV]xxxx[FL]xx[GDNS]Dxxxxx[FY];

Motif 54:
(SEQ ID NO: 625)
[GV][GDAE]xxxxWx[VITLA]xxxxxxxxW[ASPV]xxxx[FL]xx[GDNS]Dxxxxx[FY];

Motif 55:
(SEQ ID NO: 626)
[GV][GDAE]xxxxWx[VITLA]xxxxxxxxxW[ASPV]xxxx[FL]xx[GDNS]Dxxxxx[FY];

Motif 56:
(SEQ ID NO: 627)
[GV][GDAE]xxxxWx[VITLA]xxxxxxxxxxW[ASPV]xxxx[FL]xx[GDNS]Dxxxxx[FY];

Motif 57:
(SEQ ID NO: 628)
[GV][GDAE]xxxxWx[VITLA]xxxxxxxxxxxW[ASPV]xxxx[FL]xx[GDNS]Dxxxxx[FY];

Motif 58:
(SEQ ID NO: 629)
[GV][GDAE]xxxxWx[VITLA]xxxxxxxxxxxxW[ASPV]xxxx[FL]xx[GDNS]Dxxxxx[FY];

Motif 59
(SEQ ID NO: 630)
[GV][GDAE]xxxxWx[VITLA]xxxxxxxxxxxxxW[ASPV]xxxx[FL]xx[GDNS]Dxxxxx[FY].

Alternatively, or in combination therewith, in another embodiment, a PLST-like polypeptide useful in methods of the invention comprises a sequence motifs having at least, in increasing order of preference 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to following motif:

Motif 60:
(SEQ ID NO: 631)
[FHY][YF][FY][TAI]S[GAD]xx[GD][HRN]C.

These motifs are consensus sequences and will not always be identical in PLST-like sequences. It is noted that the amino acids herein indicated in square brackets represent alternative amino acids for a particular position. In the herein given sequences the "x" can be any distinct amino acid.

In another preferred embodiment of the present invention the PLST-like polypeptide of the invention may comprise any one or more sequence motifs having at least, in increasing order of preference 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to anyone of the following motifs:

Motif 22:
(SEQ ID NO: 533)
[DN]GN[TS][LVK][FV][KN][LF][DT]R[SP]GP[FY]YF[IT]SG[VA][KP][GD][HN]CEK[GN][QE]K;

Motif 23:
(SEQ ID NO: 534)
[YL]N[QK]WA[EK][KS][NH]RF[KQ][IV]GD[ST]L[LV]F[LK]Y[PD];

Motif 24:
(SEQ ID NO: 535)
[KQ]DSV[LI]QVTKE[DA]YKSCNT[SK][DSN]PI;

Motif 61:
(SEQ ID NO: 632)
[DNT][GDE][NDKH][TS][LVKM][FVYI]x[LIF]xxxGx[FYHV][YF][FYI][ITVA]S[GAD]xxxxxC;

Motif 62:
(SEQ ID NO: 633)
[DNT][GDE][NDKH][TS][LVKM][FVYI]x[LIF]xxxGx[FYHV][YF][FYI][ITVA]S[GAD]xxxxxxC;

Motif 63:
(SEQ ID NO: 667)
[DNT][GDE][NDKH][TS][LVKM][FVYI]x[LIF]xxxGx[FYHV][YF][FYI][ITVA]S[GAD]xxxxC;

Motif 64:
(SEQ ID NO: 634)
[NSDT]xW[ASPV]xxx[RSNT][FLV]x[VILT][GN]Dx[LIV]x[FLW]x[YF];

Motif 65:
(SEQ ID NO: 635)
S[VALM][LIM]x[VL]xxxx[YF]xxC[NTKD][SKTDG]xx[PAHY].

Motifs 22, 23 and 24, and motifs 61 to 65 correspond to consensus sequences, which represent conserved protein regions in a polypeptide of a group comprising the PLST-like, P_Class (to which *Arabidopsis thaliana* and *P. trichocarpa* belong), and the NDL.

Most preferably, the PLST-like polypeptide of the invention may comprise any one or more sequence motifs having at least, in increasing order of preference 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to anyone of the following motifs:

Motif 25:
(SEQ ID NO: 536)
DSVI[QV]VT[EKA][EQ]S[YF][KN][SK]CNL[KST]DPIL[YF][MS]N[ND]GN[ST][LV]FN [LI][TD][RS]PGL[FY]YF[TI]SG[VA][PS]GHC[EQ][KR];

Motif 26:
(SEQ ID NO: 537)
P[PT]SA[DN]P[DQ][VL]YTKW[AS][KS][NS][HN][RN]FK[IL]GD[ST][LI]LFLYP Motif 27:
(SEQ ID NO: 538)
XVS[CS]Y[QE][YF]KVG[DG]LD[AGS]W;

Motif 66:
(SEQ ID NO: 636)
DS[VALM][LVIM][QVE][VL][STA]xxx[FY]xxC[NDQ]x[KST]xP[LVIQH][LATF][YFTKS][FSLM]x[ND][GE][NDK][ST]x[FYI]x[LIF][TDSE];

Motif 67:
(SEQ ID NO: 637)
[YF]xxW[APV][KSG]xxx[FLV][KART][LIV][GN]D[SAT][LI]xFxY;

Motif 68:
(SEQ ID NO: 638)
[YF]x[VA]G[DAGE]xx[GAS]Wx[VAI]P.

Motifs 25, 26 and 27 and motifs 66 to 68 correspond to a consensus sequence, which represents the most conserved protein regions in polypeptides belonging to PLST-like and P_Class group polypeptide to which *Arabidopsis thaliana* belongs.

In a most preferred embodiment of the present invention the PLST-like polypeptide of the invention may comprise any one or more sequence motifs having at least, in increasing order of preference 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to anyone of the following motifs:

Motif 28:
(SEQ ID NO: 539)
HN[FL]K[IL]GDSLLFLYPPSQDSVIQVTA[QE][SAN][YF][KN]SC[ND]L[KS]DPILY

MN[DN]GNSLFN[IL]T;

Motif 29:
(SEQ ID NO: 540)
GDFYFTSG[AVE]PGHC[EQ]K[SK]QKLH[IV];

Motif 30:
(SEQ ID NO: 541)
VSCYQYKVGDLD[AS]WGIPTSA[NK];

Motif 69:
(SEQ ID NO: 639)
[FLV]x[LIV]GD[SA][LIV][LFW]FLY[PL]PS[QE]DS[LMAV][LIV]Q[VL][TA]x$_2$[ASN][FY];

Motif 70:
(SEQ ID NO: 640)
C[NDQ]X[SKT][DNS]P[LVI][LAT]X[MFL]X[ND]GN[ST][LAV][NK][LFI][ST];

Motif 71:
(SEQ ID NO: 641)
Gxx[FHY][YF][FY][TAI]S[GAD]xxG[HR]Cx[KR]x[QS][KR][LAI];

Motif 72:
(SEQ ID NO: 642)
[YF][KQ]VG[DAGN]L[DQN][AS]W[GAN][VAI]P[TIPS];

Motif 73:
(SEQ ID NO: 643)
GD[SA][LIV][LFW]FLY[PL]PS[QE];

Motif 74:
(SEQ ID NO: 644)
LY[PL]PS[QE].

It is understood that Motif determined by MEME (Timothy L. Bailey and Charles Elkan, "Fitting a mixture model by expectation maximization to discover motifs in biopolymers", Proceedings of the Second International Conference on Intelligent Systems for Molecular Biology, pp. 28-36, AAAI Press, Menlo Park, Calif., 1994) 19, 20, 21, 22, 23, 24, 25, 26, 27, 28, 29 and 30 as referred herein represent the consensus sequence of motifs as present in a PLST-like polypeptide, preferably in a PLST-like polypeptide of Table A5, more preferably in SEQ ID NO: 411. Motifs as defined herein are not limited to their respective sequence but they encompass the homologous motifs as present in any PLST-like.

It is understood that Motif determined by MEME (Timothy L. Bailey and Charles Elkan, "Fitting a mixture model by expectation maximization to discover motifs in biopolymers", Proceedings of the Second International Conference on Intelligent Systems for Molecular Biology, pp. 28-36, AAAI Press, Menlo Park, Calif., 1994) 44 to 74 as referred herein represent the consensus sequence of motifs as present in a PLST-like polypeptide, preferably in a PLST-like polypeptide of Table A5, more preferably in SEQ ID NO: 411. Motifs as defined herein are not limited to their respective sequence but they encompass the homologous motifs as present in any PLST-like Methods to identify homologous motif to Motifs 19 to 30 and/or Motifs 44 to 74 in a polypeptide useful in the methods of the present invention are well known in the art. For example the polypeptide may be compared to the motif by aligning their respective amino acid sequence to identify regions with similar sequence using an algorithm such as Blast (Altschul et al. (1990) J. Mol. Biol. 215: 403-10).

Alternatively, the homologue of PLST-like polypeptide has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by any of the polypeptides of Table A5, preferably by the SEQ ID NO: 411, provided that the homolog polypeptide comprises the conserved motifs as outlined above. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered. For local alignments, the Smith-Waterman algorithm is particularly useful (Smith T F, Waterman M S (1981) J. Mol. Biol. 147(1); 195-7).

Preferably, the sequences of PLST-like polypeptides, when used in the construction of a phylogenetic tree, such as the one depicted in FIG. 15, clusters with the group of PLST-like polypeptides comprising the amino acid sequences represented by SEQ ID NO: 411.

In another embodiment, a "protein useful in the methods of the invention" is taken to mean a Glomalin polypeptide as defined herein. In another embodiment, a "nucleic acid useful in the methods of the invention" is taken to mean a nucleic acid capable of encoding such a Glomalin polypeptide. A nucleic acid to be introduced into a plant, and therefore useful in performing the methods of the invention, is in such embodiment any nucleic acid encoding the type of protein which will now be described, hereafter also named "Glomalin nucleic acid" or "Glomalin gene".

A "Glomalin polypeptide" as defined herein refers to any heat shock protein 60 (HSP60 polypeptide) comprising a Cpn60_TCP1 domain (Pfam accession PF00118) and further comprising Motifs 31, 32 and 33, or a motif having not more than 2 mismatches to Motifs 31 to 33.

Motif 31 (SEQ ID NO: 596): DDT(I/V/L)(I/V)L(D/H)G(G/A/L)G(N/D/E)K(A/T/K/Q)X(I/L)(E/D) (E/D), wherein X is any amino acid, preferably one of I, A, S, G, L, Q, T Motif 32 (SEQ ID NO: 597): (T/A)(S/A/N/E)N(F/E/D)(D/G)(E/Q)(K/R)(V/I/R)GV(Q/E)

Motif 33 (SEQ ID NO: 598): (E/Q)X(N/D)X(N/S/D)(I/L/F/M)G(Y/F/C)DAA(K/R)(A/G/D) (E/K/T)Y(V/L)(D/H)M, wherein X in position 2 is any amino acid, preferably one of A, T, S, D, E, X in position 4 is any amino acid, preferably one of L, P, T, C Additionally or alternatively, the Glomalin polypeptide comprises one or more of the Motifs 34 to 43.

Motif 34 (SEQ ID NO: 599): L(Q/R/K)GV(E/S/N)(Q/E/D)(V/L)A(D/E)AV(K/Q)VTMGPKGR (T/H/N)V(V/I)(I/L)EXS, wherein X is any amino acid, preferably one of Q, S, R, K, G, most preferably Q.

Motif 35 (SEQ ID NO: 600): KDGVTVAK(A/S)(I/V)(E/S/K/N)F

Motif 36 (SEQ ID NO: 601): (KQ)(N/S)(I/V)GA(S/E/D/N)LVK(S/Q)VA(S/N/E/D)(S/A)TN

Motif 37 (SEQ ID NO: 602): TT(C/A)AT(V/I)L(T/A)(R/K/Q)AI(F/L)XEGCK(S/A)V(A/S)AG (M/V)(N/S)AM-DLR, wherein X is any amino acid, preferably one of V, A, T, S, I Motif 38 (SEQ ID NO: 603): TISANG Motif 39 (SEQ ID NO: 604): GK(E/H/D)GVIT(V/I)XDG(K/N)T(L/M), wherein X is any amino acid, preferably one of S, A, Q, T, V Motif 40 (SEQ ID NO: 605): RGY(I/T)SPYF(V/I)T(N/D)

Motif 41 (SEQ ID NO: 606): PLLI(V/I)(A/S)ED(V/L/I)(E/D)

Motif 42 (SEQ ID NO: 607): K(A/S)PGFG(E/D)(N/S)R

Motif 43 (SEQ ID NO: 608, located in the C-terminal end of the protein sequence): GMGG More preferably, the Glomalin polypeptide comprises in increasing order of preference, at least 3, at least 4, at least 5, at least 6, at least 7, at least 8, at least 9, at least 10, at least 11, at least 12, or all 13 motifs. Furthermore, the glomalin preferably has no secretion signal.

Additionally or alternatively, the homologue of a Glomalin protein has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 546, provided that the homologous protein comprises any one or more of the conserved motifs as outlined above. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered. Preferably the motifs in a Glomalin polypeptide have, in increasing order of preference, at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the motifs represented by SEQ ID NO: 596 to SEQ ID NO: 608 (Motifs 31 to 43).

Preferably, the polypeptide sequence which when used in the construction of a phylogenetic tree, such as the one depicted in FIG. 19, clusters with the group of Glomalin polypeptides comprising the amino acid sequence represented by SEQ ID NO: 546 rather than with any other group.

The terms "domain", "signature" and "motif" are defined in the "definitions" section herein. Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244), InterPro (Mulder et al., (2003) Nucl. Acids. Res. 31, 315-318), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAI Press, Menlo Park; Hulo et al., Nucl. Acids. Res. 32:D134-D137, (2004)), or Pfam (Bateman et al., Nucleic Acids Research 30(1): 276-280 (2002)). A set of tools for in silico analysis of protein sequences is available on the ExPASy proteomics server (Swiss Institute of Bioinformatics (Gasteiger et al., ExPASy: the proteomics server for in-depth protein knowledge and analysis, Nucleic Acids Res. 31:3784-3788 (2003)). Domains or motifs may also be identified using routine techniques, such as by sequence alignment.

Concerning PLATZ polypeptides, an alignment of the PLATZ-A1-α polypeptides given in Table A4 herein is shown in FIG. 11. Such alignments are useful for identifying the most conserved domains or motifs between the PLATZ polypeptides as defined herein. One such domain is the PLATZ domain, indicated in bold italics in FIG. 10. Examples of such motifs are SEQ ID NO: 264 to SEQ ID NO: 272 marked with the respective motif numbers in FIG. 10.

Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences.). Minor manual editing may be performed to optimise alignment between conserved motifs, as would be apparent to a person skilled in the art. Furthermore, instead of using full-length sequences for the identification of homologues, specific domains may also be used. The sequence identity values may be determined over the entire nucleic acid or amino acid sequence or over selected domains or conserved motif(s), using the programs mentioned above using the default parameters. For local alignments, the Smith-Waterman algorithm is particularly useful (Smith T F, Waterman M S (1981) J. Mol. Biol 147(1); 195-7).

Concerning PLATZ polypeptides, example 3 describes in Table B3 the percentage identity between various PLATZ polypeptides, in particular the percentage identity between SEQ ID NO: 261 (indicated as Pt583639) and other PLATZ-A1-α polypeptides, which can be as low as 70%. Typically, the percentage identity within the group of PLATZ-A1-α polypeptides is 55% or higher.

The task of protein subcellular localisation prediction is important and well studied. Knowing a protein's localisation helps elucidate its function. Experimental methods for protein localization range from immunolocalization to tagging of proteins using green fluorescent protein (GFP) or beta-glucuronidase (GUS). Such methods are accurate although labor-intensive compared with computational methods. Recently much progress has been made in computational prediction of protein localisation from sequence data. Among algorithms well known to a person skilled in the art are available at the ExPASy Proteomics tools hosted by the Swiss Institute for Bioinformatics, for example, PSort, TargetP, ChloroP, LocTree, Predotar, LipoP, MITOPROT, PATS, PTS1, SignalP, TMHMM, and others.

Concerning PLATZ polypeptides, PLATZ proteins, as DNA-binding proteins likely have a nuclear localisation.

Furthermore, eRF1 polypeptide (at least in their native form) typically have a regulation of floral meristem activity. Tools and techniques for measuring floral meristem activity are well known in the art.

In addition, eRF1 polypeptide, when expressed in rice according to the methods of the present invention as outlined in the Examples section, give plants having enhanced yield related traits, in particular seed yield and also biomass.

Additionally, eRF1 polypeptide may display a preferred subcellular localization, typically one or more of nuclear, cytoplasmic, chloroplastic, or mitochondrial. The task of protein subcellular localisation prediction is important and well studied. Knowing a protein's localisation helps elucidate its function. Experimental methods for protein localization range from immunolocalization to tagging of proteins using green fluorescent protein (GFP) or beta-glucuronidase (GUS). Such methods are accurate although labor-intensive compared with computational methods. Recently much progress has been made in computational prediction of protein localisation from sequence data. Among algorithms well known to a person skilled in the art are available at the ExPASy Proteomics tools hosted by the Swiss Institute for Bioinformatics, for example, PSort, TargetP, ChloroP, LocTree, Predotar, LipoP, MITOPROT, PATS, PTS1, SignalP, TMHMM, and others.

Furthermore, SCAMP-like polypeptides (at least in their native form) typically have EH-protein binding activity. Tools and techniques for measuring protein binding activity to EH-proteins are well known in the art.

In addition, SCAMP-like polypeptides, when expressed in rice according to the methods of the present invention as outlined in the Example section, give plants having increased yield related traits, in particular increase seed and/or biomass yield in plants growing under nitrogen deficiency growth conditions, such as those described in the Examples Section.

Additionally, SCAMP-like polypeptides may display a preferred subcellular localization, typically one or more of nuclear, cytoplasmic, chloroplastic, or mitochondrial. The task of protein subcellular localisation prediction is important and well studied. Knowing a protein's localisation helps elucidate its function. Experimental methods for protein localization range from immunolocalization to tagging of proteins using green fluorescent protein (GFP) or beta-glucuronidase (GUS). Such methods are accurate although labor-intensive compared with computational methods. Recently much progress has been made in computational prediction of protein localisation from sequence data. Among algorithms well known to a person skilled in the art are available at the ExPASy Proteomics tools hosted by the Swiss Institute for Bioinformatics, for example, PSort, TargetP, ChloroP, LocTree, Predotar, LipoP, MITOPROT, PATS, PTS1, SignalP, TMHMM, and others. Preferably the SCAMP polypeptide of the invention is preferably attached to a membrane, preferably to a membrane of the endoplamic reticulum.

On another preferred embodiment of the invention, the SCAMP polypeptide of the invention is attached to a membrane. Methods to attach (also referred to as anchored) polypeptides to a membrane or to increase the proportion of a polypeptide in a cell attached to a membrane are well known in the art. For example, a GPI (glycosyl-phosphatidylinositol) (GPI) moiety motif may be linked typically, covalently linked, to in increasing order of preference the N-teminus, the C-terminus, the Central part of a SCAMP polypeptide (Bertozzi et al. Biochemistry. 2008 Jul. 8; 47(27):6991-7000). Alternatively, the SCAMP polypeptide may be enriched in the Proline and or Alanine reisidues. Such residues are typically modified by sugars on a cell and subsequently sequester in mebranes, predominantly the plasma membrane (Kjellbom P, Snogerup L, Stöhr C, Reuzeau C, McCabe P F, Pennell R I. Plant J. 1997 November; 12(5):1189-96).

Fibrillin polypeptides, when expressed in rice according to the methods of the present invention as outlined in the Examples section herein, give plants having increased yield related traits.

Fibrillin polypeptides are typically display a preferred subcellular localization in the chloroplast. The task of protein subcellular localisation prediction is important and well studied. Knowing a protein's localisation helps elucidate its function. Experimental methods for protein localization range from immunolocalization to tagging of proteins using green fluorescent protein (GFP) or beta-glucuronidase (GUS). Such methods are accurate although labour-intensive compared with computational methods. Recently much progress has been made in computational prediction of protein localisation from sequence data. Among algorithms well known to a person skilled in the art are available at the ExPASy Proteomics tools hosted by the Swiss Institute for Bioinformatics, for example, PSort, TargetP, ChloroP, LocTree, Predotar, LipoP, MITOPROT, PATS, PTS1, SignalP, TMHMM, and others.

Furthermore, PLATZ polypeptides (at least in their native form) typically have zinc-dependent DNA-binding activity. Tools and techniques for measuring DNA-binding activity are well known in the art (see for example Nagano et al., 2001). Further details are provided in The Examples section.

In addition, PLATZ polypeptides, when expressed in rice according to the methods of the present invention as outlined in the Examples section, give plants having increased yield related traits, in particular increased seed yield, such as e.g. increased total weight of seeds and/or increased fill rate and/or increased thousand kernel weight; and/or increased harvest index; and/or increased above-ground biomass (also referred to as areamax herein) and/or quick early development, etc.

In addition, PLST-like polypeptide, when expressed in rice according to the methods of the present invention as outlined in the Examples section, give plants having enhanced yield related traits, in particular seed yield and also biomass.

Additionally, PLST-like polypeptide may display a preferred subcellular localization, typically one or more of nuclear, cytoplasmic, chloroplastic, or mitochondrial. The task of protein subcellular localisation prediction is important and well studied. Knowing a protein's localisation helps elucidate its function. Experimental methods for protein localization range from immunolocalization to tagging of proteins using green fluorescent protein (GFP) or beta-glucuronidase (GUS). Such methods are accurate although labor-intensive compared with computational methods. Recently much progress has been made in computational prediction of protein localisation from sequence data. Among algorithms well known to a person skilled in the art are available at the ExPASy Proteomics tools hosted by the Swiss Institute for Bioinformatics, for example, PSort, TargetP, ChloroP, LocTree, Predotar, LipoP, MITOPROT, PATS, PTS1, SignalP, TMHMM, and others.

Furthermore, Glomalin polypeptides (at least in their native form) typically rescue temperature sensitive mutants (Hemmingsen et al., Nature 333, 330-334, 1988, Salvucci, J. Exp. Bot. 59, 1923-1933, 2008).

In addition, Glomalin polypeptides, when expressed in rice according to the methods of the present invention as outlined in the Examples section, give plants having increased yield related traits, in particular increased harvest index.

Concerning eRF1 polypeptides, the present invention is illustrated by transforming plants with the nucleic acid sequence represented by SEQ ID NO: 1, encoding the polypeptide sequence of SEQ ID NO: 2. However, performance of the invention is not restricted to these sequences; the methods of the invention may advantageously be performed using any eRF1 polypeptide encoding nucleic acid or eRF1 polypeptide as defined herein.

Examples of nucleic acids encoding eRF1 polypeptide are given in Table A1 of the Examples section herein. Such nucleic acids are useful in performing the methods of the invention. The amino acid sequences given in Table A1 of the Examples section are example sequences of orthologues and paralogues of the eRF1 polypeptide represented by SEQ ID NO: 2, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A1 of the Examples section) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived. The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning SCAMP-like polypeptides, the present invention is illustrated by transforming plants with the nucleic acid sequence represented by SEQ ID NO: 88, encoding the polypeptide sequence of SEQ ID NO: 89. However, performance of the invention is not restricted to these sequences; the methods of the invention may advantageously be performed using any SCAMP-like-encoding nucleic acid or SCAMP-LIKE polypeptide as defined herein.

Examples of nucleic acids encoding SCAMP-like polypeptides are given in Table A2 of the Examples section herein. Such nucleic acids are useful in performing the methods of the invention. The amino acid sequences given in Table A2 of the Examples section are example sequences of orthologues and paralogues of the SCAMP-like polypeptide represented by SEQ ID NO: 89, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A2 of the Examples section) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 88 or SEQ ID NO: 89, the second BLAST would therefore be against *Arabidopsis thaliana* sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning fibrillin polypeptides, the present invention is illustrated by transforming plants with the nucleic acid sequence represented by SEQ ID NO: 204, encoding the polypeptide sequence of SEQ ID NO: 205. However, performance of the invention is not restricted to these sequences; the methods of the invention may advantageously be performed using any fibrillin-encoding nucleic acid or fibrillin polypeptide as defined herein.

Examples of nucleic acids encoding fibrillin polypeptides are given in Table A3 of the Examples section herein. Such nucleic acids are useful in performing the methods of the invention. The amino acid sequences given in Table A3 of the Examples section are example sequences of orthologues and paralogues of the fibrillin polypeptide represented by SEQ ID NO: 205, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A3 of the Examples section) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 204 or SEQ ID NO: 205, the second BLAST would therefore be against tomato sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning PLATZ polypeptides, the present invention is illustrated by transforming plants with the nucleic acid sequence represented by SEQ ID NO: 260, encoding the polypeptide sequence of SEQ ID NO: 261. However, performance of the invention is not restricted to these sequences; the methods of the invention may advantageously be performed using any PLATZ-encoding nucleic acid or PLATZ polypeptide as defined herein. For example, in another embodiment the present invention is illustrated by transforming plants with the nucleic acid sequence represented by SEQ ID NO: 356, encoding the polypeptide sequence of SEQ ID NO: 357.

Examples of nucleic acids encoding PLATZ polypeptides are given in Table A4 of the Examples section herein. Such nucleic acids are useful in performing the methods of the invention. The amino acid sequences given in Table A4 of the Examples section are example sequences of orthologues and paralogues of the PLATZ polypeptide represented by SEQ ID NO: 261, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A4 of the Examples section) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 260 or SEQ ID NO: 261, the second BLAST would therefore be against poplar sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning PLST-like polypeptides, the present invention is illustrated by transforming plants with the nucleic acid sequence represented by SEQ ID NO: 410, encoding the polypeptide sequence of SEQ ID NO: 411. However, performance of the invention is not restricted to these sequences; the methods of the invention may advantageously be performed using any PLST-like polypeptide encoding nucleic acid or PLST-like polypeptide as defined herein.

Examples of nucleic acids encoding PLST-like polypeptide are given in Table A5 of the Examples section herein. Such nucleic acids are useful in performing the methods of the invention. The amino acid sequences given in Table A5 of the Examples section are example sequences of orthologues and paralogues of the PLST-like polypeptide represented by SEQ ID NO: 411, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A5 of the Examples section) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived. The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning Glomalin polypeptides, the present invention is illustrated by transforming plants with the nucleic acid sequence represented by SEQ ID NO: 545, encoding the polypeptide sequence of SEQ ID NO: 546. However, performance of the invention is not restricted to these sequences; the methods of the invention may advantageously be performed using any Glomalin-encoding nucleic acid or Glomalin polypeptide as defined herein.

Examples of nucleic acids encoding Glomalin polypeptides are given in Table A6 of the Examples section herein. Such nucleic acids are useful in performing the methods of the invention. The amino acid sequences given in Table A6 of the Examples section are example sequences of orthologues and paralogues of the Glomalin polypeptide represented by SEQ ID NO: 546, the terms "orthologues" and "paralogues" being as defined herein. Further orthologues and paralogues may readily be identified by performing a so-called reciprocal blast search as described in the definitions section; where the query sequence is SEQ ID NO: 545 or SEQ ID NO: 546, the second BLAST (back-BLAST) would be against rice sequences.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

Nucleic acid variants may also be useful in practising the methods of the invention. Examples of such variants include nucleic acids encoding homologues and derivatives of any one of the amino acid sequences given in Table A1 to A6 of the Examples section, the terms "homologue" and "derivative" being as defined herein. Also useful in the methods of the invention are nucleic acids encoding homologues and derivatives of orthologues or paralogues of any one of the amino acid sequences given in Table A1 to A6 of the Examples section. Homologues and derivatives useful in the methods of the present invention have substantially the same biological and functional activity as the unmodified protein from which they are derived. Further variants useful in practising the methods of the invention are variants in which codon usage is optimised or in which miRNA target sites are removed.

Further nucleic acid variants useful in practising the methods of the invention include portions of nucleic acids encoding an eRF1 polypeptide, or a SCAMP-like polypeptide, or a fibrillin polypeptide, or a PLATZ polypeptide, or a PLST-like polypeptide, or a Glomalin polypeptide, nucleic acids hybridising to nucleic acids encoding an eRF1 polypeptide, or a SCAMP-like polypeptide, or a fibrillin polypeptide, or a PLATZ polypeptide, or a PLST-like polypeptide, or a Glomalin polypeptide, splice variants of nucleic acids encoding an eRF1 polypeptide, or a SCAMP-like polypeptide, or a fibrillin polypeptide, or a PLATZ polypeptide, or a PLST-like polypeptide, or a Glomalin polypeptide, allelic variants of nucleic acids encoding an eRF1 polypeptide, or a SCAMP-like polypeptide, or a fibrillin polypeptide, or a PLATZ polypeptide, or a PLST-like polypeptide, or a Glomalin polypeptide, and variants of nucleic acids encoding an eRF1 polypeptide, or a SCAMP-like polypeptide, or a fibrillin polypeptide, or a PLATZ polypeptide, or a PLST-like polypeptide, or a Glomalin polypeptide, obtained by gene shuffling. The terms hybridising sequence, splice variant, allelic variant and gene shuffling are as described herein.

Nucleic acids encoding an eRF1 polypeptide, or a SCAMP-like polypeptide, or a fibrillin polypeptide, or a PLATZ polypeptide, or a PLST-like polypeptide, or a Glomalin polypeptide, need not be full-length nucleic acids, since performance of the methods of the invention does not rely on the use of full-length nucleic acid sequences. According to the present invention, there is provided a method for enhancing yield-related traits in plants, comprising introducing and expressing in a plant a portion of any one of the nucleic acid sequences given in Table A1 to A6 of the Examples section, or a portion of a nucleic acid encoding an orthologue, paralogue or homologue of any of the amino acid sequences given in Table A1 to A6 of the Examples section.

A portion of a nucleic acid may be prepared, for example, by making one or more deletions to the nucleic acid. The portions may be used in isolated form or they may be fused to other coding (or non-coding) sequences in order to, for example, produce a protein that combines several activities. When fused to other coding sequences, the resultant polypeptide produced upon translation may be bigger than that predicted for the protein portion.

Concerning eRF1 polypeptides, portions useful in the methods of the invention, encode an eRF1 polypeptide as defined herein, and have substantially the same biological activity as the amino acid sequences given in Table A1 of the Examples section. Preferably, the portion is a portion of any one of the nucleic acids given in Table A1 of the Examples section, or is a portion of a nucleic acid encoding an orthologue or paralogue of any one of the amino acid sequences given in Table A1 of the Examples section. Preferably the portion is at least 500, 550, 600, 650, 700, 750, 800, 850, 900, 950, 1000, 1050, 1100, 1150, 1200, 1250, 1300, 1350 consecutive nucleotides in length, the consecutive nucleotides being of any one of the nucleic acid sequences given in Table A1 of the Examples section, or of a nucleic acid encoding an orthologue or paralogue of any one of the amino acid sequences given in Table A1 of the Examples section. Most preferably the portion is a portion of the nucleic acid of SEQ ID NO: 1. Preferably, the portion encodes a fragment of an amino acid sequence which, when used in the construction of a phylogenetic tree, such as the one depicted in FIG. 1, clusters with the group of eRF1 polypeptide comprising the amino acid sequence represented by SEQ ID NO: 2 rather than with any other group.

Concerning SCAMP-like polypeptides, portions useful in the methods of the invention, encode a SCAMP-like polypeptide as defined herein, and have substantially the same biological activity as the amino acid sequences given in Table A2 of the Examples section. Preferably, the portion is a portion of any one of the nucleic acids given in Table A2 of the Examples section, or is a portion of a nucleic acid encoding an orthologue or paralogue of any one of the amino acid sequences given in Table A2 of the Examples section. Preferably the portion is at least 100, 200, 300, 400, 500, 550, 600, 650, 700, 750, 800, 850, 900, 950, 1000 consecutive nucleotides in length, the consecutive nucleotides being of any one of the nucleic acid sequences given in Table A2 of the Examples section, or of a nucleic acid encoding an orthologue or paralogue of any one of the amino acid sequences given in Table A2 of the Examples section. Most preferably the portion is a portion of the nucleic acid of SEQ ID NO: 88. Preferably, the portion encodes a fragment of an amino acid sequence comprising a SCAMP domain as defined herein.

Concerning fibrillin polypeptides, portions useful in the methods of the invention, encode a fibrillin polypeptide as defined herein, and have substantially the same biological activity as the amino acid sequences given in Table A3 of the Examples section. Preferably, the portion is a portion of any one of the nucleic acids given in Table A3 of the Examples section, or is a portion of a nucleic acid encoding an orthologue or paralogue of any one of the amino acid sequences given in Table A3 of the Examples section. Preferably the portion is at least 500, 550, 600, 650, 700, 750, 800, 850, 900, 950, 1000 consecutive nucleotides in length, the consecutive nucleotides being of any one of the nucleic acid sequences given in Table A3 of the Examples section, or of a nucleic acid encoding an orthologue or paralogue of any one of the amino acid sequences given in Table A3 of the Examples section. Most preferably the portion is a portion of the nucleic acid of SEQ ID NO: 204. Preferably, the portion encodes a fragment of an amino acid sequence which, when used in the construction of a phylogenetic tree, such as the one depicted in FIG. 6, clusters with the group of fibrillin polypeptides comprising the amino acid sequence represented by SEQ ID NO: 205 rather than with any other group.

Concerning PLATZ polypeptides, portions useful in the methods of the invention, encode a PLATZ polypeptide as defined herein, and have substantially the same biological activity as the amino acid sequences given in Table A4 of the Examples section. Preferably, the portion is a portion of any one of the nucleic acids given in Table A4 of the Examples section, or is a portion of a nucleic acid encoding an orthologue or paralogue of any one of the amino acid sequences given in Table A4 of the Examples section. Preferably the portion is at least 300, 350, 400, 450, 500, 550, 600, 650, 700, 750, 800, 850, 900, 950, 1000, 1050, 1100 consecutive nucleotides in length, the consecutive nucleotides being of any one of the nucleic acid sequences given in Table A4 of the Examples section, or of a nucleic acid encoding an orthologue or paralogue of any one of the amino acid sequences given in Table A4 of the Examples section. Most preferably the portion is a portion of the nucleic acid of SEQ ID NO: 260. Preferably, the portion encodes a fragment of an amino acid sequence which comprises a PLATZ domain and one or more of the motifs defined above, and which, when used in the construction of a phylogenetic tree, such as the one depicted in FIG. 12, clusters with the group of PLATZ-A polypeptides, more preferably with the group of PLATZ-A1 proteins, most preferably with the group of PLATZ-A1-α proteins, comprising the amino acid sequence represented by SEQ ID NO: 261 rather than with any other group of PLATZ proteins.

Concerning PLST-like polypeptides, portions useful in the methods of the invention, encode a PLST-like polypeptide as defined herein, and have substantially the same biological activity as the amino acid sequences given in Table A5 of the Examples section. Preferably, the portion is a portion of any one of the nucleic acids given in Table A5 of the Examples section, or is a portion of a nucleic acid encoding an orthologue or paralogue of any one of the amino acid sequences given in Table A5 of the Examples section. Preferably the portion is at least 100, 150, 200, 250, 300, 350, 400, 450, 500, 550, 600, 650, 700 consecutive nucleotides in length, the consecutive nucleotides being of any one of the nucleic acid sequences given in Table A5 of the Examples section, or of a nucleic acid encoding an orthologue or paralogue of any one of the amino acid sequences given in Table A5 of the Examples section. Most preferably the portion has one or more of motifs 1 to 12 and the PF domain and is a portion of the nucleic acid of SEQ ID NO: 410. Preferably, the portion encodes a fragment of an amino acid sequence which, when used in the construction of a phylogenetic tree, such as the one depicted in FIG. 19, clusters with the group of PLST-like polypeptide comprising the amino acid sequence represented by SEQ ID NO: 411 rather than with any other group.

Concerning Glomalin polypeptides, portions useful in the methods of the invention, encode a Glomalin polypeptide as defined herein, and have substantially the same biological activity as the amino acid sequences given in Table A6 of the Examples section. Preferably, the portion is a portion of any one of the nucleic acids given in Table A6 of the Examples section, or is a portion of a nucleic acid encoding an orthologue or paralogue of any one of the amino acid sequences given in Table A6 of the Examples section. Preferably the portion is at least 450, 500, 550, 600, 650, 700, 750, 800, 850, 900, 950, 1000, 1050, 1100, 1150, 1200, 1250, 1300, 1350, 1400, 1450, 1500, 1550, 1600, 1650, 1700, 1750, 1800, 1850, 1900 consecutive nucleotides in length, the consecutive nucleotides being of any one of the nucleic acid sequences given in Table A6 of the Examples section, or of a nucleic acid encoding an orthologue or paralogue of any one of the amino acid sequences given in Table A6 of the Examples section. Most preferably the portion is a portion of the nucleic acid of SEQ ID NO: 545. Preferably, the portion encodes a fragment of an amino acid sequence which comprises a Cpn60_TCP1 domain (Pfam accession PF00118), or which when used in the construction of a phylogenetic tree, such as the one depicted in FIG. 19, clusters with the group of Glomalin polypeptides comprising the amino acid sequence represented by SEQ ID NO: 546 rather than with any other group.

Another nucleic acid variant useful in the methods of the invention is a nucleic acid capable of hybridising, under reduced stringency conditions, preferably under stringent conditions, with a nucleic acid encoding an eRF1 polypeptide, or a SCAMP-like polypeptide, or a fibrillin polypeptide, or a PLATZ polypeptide, or a PLST-like polypeptide, or a Glomalin polypeptide, as defined herein, or with a portion as defined herein.

According to the present invention, there is provided a method for enhancing yield-related traits in plants, comprising introducing and expressing in a plant a nucleic acid capable of hybridizing to any one of the nucleic acids given in Table A1 to A6 of the Examples section, or comprising introducing and expressing in a plant a nucleic acid capable of hybridising to a nucleic acid encoding an orthologue, paralogue or homologue of any of the nucleic acid sequences given in Table A1 to A6 of the Examples section.

Concerning eRF1 polypeptides, hybridising sequences useful in the methods of the invention encode an eRF1 polypeptide as defined herein, having substantially the same biological activity as the amino acid sequences given in Table A1 of the Examples section. Preferably, the hybridising sequence is capable of hybridising to the complement of any one of the nucleic acids given in Table A1 of the Examples section, or to a portion of any of these sequences, a portion being as defined above, or the hybridising sequence is capable of hybridising to the complement of a nucleic acid encoding an orthologue or paralogue of any one of the amino acid sequences given in Table A1 of the Examples section. Most preferably, the hybridising sequence is capable of hybridising to the complement of a nucleic acid as represented by SEQ ID NO: 1 or to a portion thereof.

Preferably, the hybridising sequence encodes a polypeptide with an amino acid sequence which, when full-length and used in the construction of a phylogenetic tree, such as the one depicted in FIG. 1, clusters with the group of eRF1 polypeptide comprising the amino acid sequence represented by SEQ ID NO: 2 rather than with any other group.

Concerning SCAMP-like polypeptides, hybridising sequences useful in the methods of the invention encode a SCAMP-like polypeptide as defined herein, having substantially the same biological activity as the amino acid sequences given in Table A2 of the Examples section. Preferably, the hybridising sequence is capable of hybridising to the complement of any one of the nucleic acids given in Table A2 of the Examples section, or to a portion of any of these sequences, a portion being as defined above, or the hybridising sequence is capable of hybridising to the complement of a nucleic acid encoding an orthologue or paralogue of any one of the amino acid sequences given in Table A2 of the Examples section. Most preferably, the hybridising sequence is capable of hybridising to the complement of a nucleic acid as represented by SEQ ID NO: 88 or to a portion thereof.

Preferably, the hybridising sequence encodes a polypeptide with an amino acid sequence comprising a SCAMP domain as defined herein.

Concerning fibrillin polypeptides, hybridising sequences useful in the methods of the invention encode a fibrillin polypeptide as defined herein, having substantially the same biological activity as the amino acid sequences given in Table A3 of the Examples section. Preferably, the hybridising sequence is capable of hybridising to the complement of any one of the nucleic acids given in Table A3 of the Examples section, or to a portion of any of these sequences, a portion being as defined above, or the hybridising sequence is capable of hybridising to the complement of a nucleic acid encoding an orthologue or paralogue of any one of the amino acid sequences given in Table A3 of the Examples section. Most preferably, the hybridising sequence is capable of hybridising to the complement of a nucleic acid as represented by SEQ ID NO: 204 or to a portion thereof.

Preferably, the hybridising sequence encodes a polypeptide with an amino acid sequence which, when full-length and used in the construction of a phylogenetic tree, such as the one depicted in FIG. 6, clusters with the group of fibrillin polypeptides comprising the amino acid sequence represented by SEQ ID NO: 205 rather than with any other group.

Concerning PLATZ polypeptides, hybridising sequences useful in the methods of the invention encode a PLATZ polypeptide as defined herein, having substantially the same biological activity as the amino acid sequences given in Table A4 of the Examples section. Preferably, the hybridising sequence is capable of hybridising to the complement of any one of the nucleic acids given in Table A4 of the Examples section, or to a portion of any of these sequences, a portion being as defined above, or the hybridising sequence is capable of hybridising to the complement of a nucleic acid encoding an orthologue or paralogue of any one of the amino acid sequences given in Table A4 of the Examples section. Most preferably, the hybridising sequence is capable of hybridising to the complement of a nucleic acid as represented by SEQ ID NO: 260 or to a portion thereof.

Preferably, the hybridising sequence encodes a polypeptide with an amino acid sequence which comprises a PLATZ domain and one or more of the motifs defined above, and which, when used in the construction of a phylogenetic tree, such as the one depicted in FIG. 12, clusters with the group of PLATZ-A polypeptides, more preferably with the group of PLATZ-A1 proteins, most preferably with the group of PLATZ-A1-α proteins, comprising the amino acid sequence represented by SEQ ID NO: 261 rather than with any other group of PLATZ proteins.

Concerning PLST-like polypeptides, hybridising sequences useful in the methods of the invention encode a PLST-like polypeptide as defined herein, having substantially the same biological activity as the amino acid sequences given in Table A5 of the Examples section. Preferably, the hybridising sequence is capable of hybridising to the complement of any one of the nucleic acids given in Table A5 of the Examples section, or to a portion of any of these sequences, a portion being as defined above, or the hybridising sequence is capable of hybridising to the complement of a nucleic acid encoding an orthologue or paralogue of any one of the amino acid sequences given in Table A5 of the Examples section. Most preferably, the hybridising sequence is capable of hybridising to the complement of a nucleic acid as represented by SEQ ID NO: 410 or to a portion thereof.

Preferably, the hybridising sequence encodes a polypeptide with an amino acid sequence which, when full-length and used in the construction of a phylogenetic tree, such as the one depicted in FIG. 15, has one or more of motifs 1 to 12 and the PF domain and clusters with the group of a PLST-like polypeptide comprising the amino acid sequence represented by SEQ ID NO: 411 rather than with any other group.

Concerning Glomalin polypeptides, hybridising sequences useful in the methods of the invention encode a Glomalin polypeptide as defined herein, having substantially the same biological activity as the amino acid sequences given in Table A6 of the Examples section. Preferably, the hybridising sequence is capable of hybridising to the complement of any one of the nucleic acids given in Table A6 of the Examples section, or to a portion of any of these sequences, a portion being as defined above, or the hybridising sequence is capable of hybridising to the complement of a nucleic acid encoding an orthologue or paralogue of any one of the amino acid sequences given in Table A6 of the Examples section. Most preferably, the hybridising sequence is capable of hybridising to the complement of a nucleic acid as represented by SEQ ID NO: 545 or to a portion thereof.

Preferably, the hybridising sequence encodes a polypeptide with an amino acid sequence which comprises a Cpn60_TCP1 domain (Pfam accession PF00118), or which when used in the construction of a phylogenetic tree, such as the one depicted in FIG. 19, clusters with the group of Glomalin polypeptides comprising the amino acid sequence represented by SEQ ID NO: 546 rather than with any other group.

Another nucleic acid variant useful in the methods of the invention is a splice variant encoding an eRF1 polypeptide, or a SCAMP-like polypeptide, or a fibrillin polypeptide, or a PLATZ polypeptide, or a PLST-like polypeptide, or a Glomalin polypeptide, as defined hereinabove, a splice variant being as defined herein.

According to the present invention, there is provided a method for enhancing yield-related traits in plants, comprising introducing and expressing in a plant a splice variant of any one of the nucleic acid sequences given in Table A1 to A6 of the Examples section, or a splice variant of a nucleic acid encoding an orthologue, paralogue or homologue of any of the amino acid sequences given in Table A1 to A6 of the Examples section.

Concerning eRF1 polypeptides, preferred splice variants are splice variants of a nucleic acid represented by SEQ ID NO: 1, or a splice variant of a nucleic acid encoding an orthologue or paralogue of SEQ ID NO: 2. Preferably, the amino acid sequence encoded by the splice variant, when used in the construction of a phylogenetic tree, such as the one depicted in FIG. 1, clusters with the group of eRF1 polypeptide comprising the amino acid sequence represented by SEQ ID NO: 2 rather than with any other group.

Concerning SCAMP-like polypeptides, preferred splice variants are splice variants of a nucleic acid represented by SEQ ID NO: 88, or a splice variant of a nucleic acid encoding an orthologue or paralogue of SEQ ID NO: 89. Preferably, the amino acid sequence encoded by the splice variant comprises a SCAMP domain as defined herein.

Concerning fibrillin polypeptides, preferred splice variants are splice variants of a nucleic acid represented by SEQ ID NO: 204, or a splice variant of a nucleic acid encoding an orthologue or paralogue of SEQ ID NO: 205. Preferably, the amino acid sequence encoded by the splice variant, when used in the construction of a phylogenetic tree, such as the one depicted in FIG. 6, clusters with the group of fibrillin polypeptides comprising the amino acid sequence represented by SEQ ID NO: 205 rather than with any other group.

Concerning PLATZ polypeptides, preferred splice variants are splice variants of a nucleic acid represented by SEQ ID NO: 260, or a splice variant of a nucleic acid encoding an orthologue or paralogue of SEQ ID NO: 261. Preferably, the amino acid sequence encoded by the splice variant which comprises a PLATZ domain and one or more of the motifs defined above, and which, when used in the construction of a phylogenetic tree, such as the one depicted in FIG. 12, clusters with the group of PLATZ-A polypeptides, more preferably with the group of PLATZ-A1 proteins, most preferably with the group of PLATZ-A1-α proteins, comprising the amino acid sequence represented by SEQ ID NO: 261 rather than with any other group of PLATZ proteins.

Concerning PLST-like polypeptides, preferred splice variants are splice variants of a nucleic acid represented by SEQ ID NO: 410, or a splice variant of a nucleic acid encoding an orthologue or paralogue of SEQ ID NO: 411. Preferably, the amino acid sequence encoded by the splice variant, when used in the construction of a phylogenetic tree, such as the one depicted in FIG. 15, has one or more of motifs 19 to 30 and the PF domain and clusters with the group of a PLST-like polypeptide comprising the amino acid sequence represented by SEQ ID NO: 411 rather than with any other group.

Concerning Glomalin polypeptides, preferred splice variants are splice variants of a nucleic acid represented by SEQ ID NO: 545, or a splice variant of a nucleic acid encoding an orthologue or paralogue of SEQ ID NO: 546. Preferably, the amino acid sequence encoded by the splice variant comprises a Cpn60_TCP1 domain (Pfam accession PF00118), or when used in the construction of a phylogenetic tree, such as the one depicted in FIG. 19, clusters with the group of Glomalin polypeptides comprising the amino acid sequence represented by SEQ ID NO: 546 rather than with any other group.

Another nucleic acid variant useful in performing the methods of the invention is an allelic variant of a nucleic acid encoding an eRF1 polypeptide, or a SCAMP-like polypeptide, or a fibrillin polypeptide, or a PLATZ polypeptide, or a PLST-like polypeptide, or a Glomalin polypeptide, as defined hereinabove, an allelic variant being as defined herein.

According to the present invention, there is provided a method for enhancing yield-related traits in plants, comprising introducing and expressing in a plant an allelic variant of any one of the nucleic acids given in Table A1 to A6 of the Examples section, or comprising introducing and expressing in a plant an allelic variant of a nucleic acid encoding an orthologue, paralogue or homologue of any of the amino acid sequences given in Table A1 to A6 of the Examples section.

Concerning eRF1 polypeptides, the polypeptides encoded by allelic variants useful in the methods of the present invention have substantially the same biological activity as the eRF1 polypeptide of SEQ ID NO: 2 and any of the amino acids depicted in Table A1 of the Examples section. Allelic variants exist in nature, and encompassed within the methods of the present invention is the use of these natural alleles. Preferably, the allelic variant is an allelic variant of SEQ ID NO: 1 or allelic variant of a nucleic acid encoding an orthologue or paralogue of SEQ ID NO: 2. Preferably, the amino acid sequence encoded by the allelic variant, when used in the construction of a phylogenetic tree, such as the one depicted in FIG. 1, clusters with the eRF1 polypeptide comprising the amino acid sequence represented by SEQ ID NO: 2 rather than with any other group.

Concerning SCAMP-like polypeptides, the polypeptides encoded by allelic variants useful in the methods of the present invention have substantially the same biological activity as the SCAMP-like polypeptide of SEQ ID NO: 89 and any of the amino acids depicted in Table A2 of the Examples section. Allelic variants exist in nature, and encompassed within the methods of the present invention is the use of these natural alleles. Preferably, the allelic variant is an allelic variant of SEQ ID NO: 88 or an allelic variant of a nucleic acid encoding an orthologue or paralogue of SEQ ID NO: 89. Preferably, the amino acid sequence encoded by the allelic variant comprises a SCAMP domain as defined herein.

Concerning fibrillin polypeptides, the polypeptides encoded by allelic variants useful in the methods of the present invention have substantially the same biological activity as the fibrillin polypeptide of SEQ ID NO: 205 and any of the amino acids depicted in Table A3 of the Examples section. Allelic variants exist in nature, and encompassed within the methods of the present invention is the use of these natural alleles. Preferably, the allelic variant is an allelic variant of SEQ ID NO: 204 or an allelic variant of a nucleic acid encoding an orthologue or paralogue of SEQ ID NO: 205. Preferably, the amino acid sequence encoded by the allelic variant, when used in the construction of a phylogenetic tree, such as the one depicted in FIG. 6, clusters with the fibrillin polypeptides comprising the amino acid sequence represented by SEQ ID NO: 205 rather than with any other group.

Concerning PLATZ polypeptides, the polypeptides encoded by allelic variants useful in the methods of the present invention have substantially the same biological activity as the PLATZ polypeptide of SEQ ID NO: 261 and any of the amino acids depicted in Table A4 of the Examples section. Allelic variants exist in nature, and encompassed within the methods of the present invention is the use of these natural alleles. Preferably, the allelic variant is an allelic variant of SEQ ID NO: 260 or an allelic variant of a nucleic acid encoding an orthologue or paralogue of SEQ ID NO: 261. Preferably, the amino acid sequence encoded by the allelic variant, which comprises a PLATZ domain and one or more of the motifs defined above, and which, when used in the construction of a phylogenetic tree, such as the one depicted in FIG. 12, clusters with the group of PLATZ-A polypeptides, more preferably with the group of PLATZ-A1 proteins, most preferably with the group of PLATZ-A1-α proteins, comprising the amino acid sequence represented by SEQ ID NO: 261 rather than with any other group of PLATZ proteins.

Concerning PLST-like polypeptides, the polypeptides encoded by allelic variants useful in the methods of the present invention have substantially the same biological activity as the PLST-like polypeptide of SEQ ID NO: 411 and any of the amino acids depicted in Table A5 of the Examples section. Allelic variants exist in nature, and encompassed within the methods of the present invention is the use of these natural alleles. Preferably, the allelic variant is an allelic variant of SEQ ID NO: 410 or an allelic variant of a nucleic acid encoding an orthologue or paralogue of SEQ ID NO: 411. Preferably, the amino acid sequence encoded by the allelic variant, when used in the construction of a phylogenetic tree, such as the one depicted in FIG. 14, has one or more of motifs 19 to 30 and the PF domain and clusters with the PLST-like polypeptide comprising the amino acid sequence represented by SEQ ID NO: 411 rather than with any other group.

Concerning Glomalin polypeptides, the polypeptides encoded by allelic variants useful in the methods of the present invention have substantially the same biological activity as the Glomalin polypeptide of SEQ ID NO: 546 and any of the amino acids depicted in Table A6 of the Examples section. Allelic variants exist in nature, and encompassed within the methods of the present invention is the use of these natural alleles. Preferably, the allelic variant is an allelic variant of SEQ ID NO: 545 or an allelic variant of a nucleic acid encoding an orthologue or paralogue of SEQ ID NO: 546. Preferably, the amino acid sequence encoded by the allelic variant comprises a Cpn60_TCP1 domain (Pfam accession PF00118), or when used in the construction of a phylogenetic tree, such as the one depicted in FIG. 19, clusters with the group of Glomalin polypeptides comprising the amino acid sequence represented by SEQ ID NO: 546 rather than with any other group.

Gene shuffling or directed evolution may also be used to generate variants of nucleic acids encoding an eRF1 polypeptide, or a SCAMP-like polypeptide, or a fibrillin polypeptide, or a PLATZ polypeptide, or a PLST-like polypeptide, or a Glomalin polypeptide, as defined above; the term "gene shuffling" being as defined herein.

According to the present invention, there is provided a method for enhancing yield-related traits in plants, comprising introducing and expressing in a plant a variant of any one of the nucleic acid sequences given in Table A1 to A6 of the Examples section, or comprising introducing and expressing in a plant a variant of a nucleic acid encoding an orthologue, paralogue or homologue of any of the amino acid sequences given in Table A1 to A6 of the Examples section, which variant nucleic acid is obtained by gene shuffling.

Concerning eRF1 polypeptides, preferably, the amino acid sequence encoded by the variant nucleic acid obtained by gene shuffling, when used in the construction of a phylogenetic tree such as the one depicted in FIG. 1, clusters with the group of eRF1 polypeptide comprising the amino acid sequence represented by SEQ ID NO: 2 rather than with any other group.

Concerning SCAMP-like polypeptides, preferably, the amino acid sequence encoded by the variant nucleic acid obtained by gene shuffling comprises a SCAMP domain as defined herein.

Concerning fibrillin polypeptides, preferably, the amino acid sequence encoded by the variant nucleic acid obtained by gene shuffling, when used in the construction of a phylogenetic tree such as the one depicted in FIG. 6, clusters with the group of fibrillin polypeptides comprising the amino acid sequence represented by SEQ ID NO: 205 rather than with any other group.

Concerning PLATZ polypeptides, preferably, the amino acid sequence encoded by the variant nucleic acid obtained by gene shuffling, which comprises a PLATZ domain and one or more of the motifs defined above, and which, when used in the construction of a phylogenetic tree, such as the one depicted in FIG. 12, clusters with the group of PLATZ-A polypeptides, more preferably with the group of PLATZ-A1 proteins, most preferably with the group of PLATZ-A1-α proteins, comprising the amino acid sequence represented by SEQ ID NO: 261 rather than with any other group of PLATZ proteins.

Concerning PLST-like polypeptides, preferably, the amino acid sequence encoded by the variant nucleic acid obtained by gene shuffling, when used in the construction of a phylogenetic tree such as the one depicted in FIG. 15, clusters with the group of PLST-like polypeptide comprising the amino acid sequence represented by SEQ ID NO: 411 rather than with any other group.

Concerning Glomalin polypeptides, preferably, the amino acid sequence encoded by the variant nucleic acid obtained by gene shuffling comprises a Cpn60_TCP1 domain (Pfam accession PF00118), or when used in the construction of a phylogenetic tree, such as the one depicted in FIG. 19, clusters with the group of Glomalin polypeptides comprising the amino acid sequence represented by SEQ ID NO: 546 rather than with any other group.

Furthermore, nucleic acid variants may also be obtained by site-directed mutagenesis. Several methods are available to achieve site-directed mutagenesis, the most common being PCR based methods (Current Protocols in Molecular Biology. Wiley Eds.).

Nucleic acids encoding eRF1 polypeptide may be derived from any natural or artificial source. The nucleic acid may be modified from its native form in composition and/or genomic environment through deliberate human manipulation. Preferably the eRF1 polypeptide-encoding nucleic acid is from a plant, further preferably from a monocotyledonous plant, more preferably from the family Poaceae, most preferably the nucleic acid is from *Oryza sativa*.

Nucleic acids encoding SCAMP-LIKE polypeptides may be derived from any natural or artificial source. The nucleic acid may be modified from its native form in composition and/or genomic environment through deliberate human manipulation. Preferably the SCAMP-LIKE polypeptide-encoding nucleic acid is from a plant, further preferably from a dicotyledonous plant, more preferably from the family Brassicaceae, most preferably the nucleic acid is from *Arabidopsis thaliana*.

Any of the aforementioned fibrillin polypeptide sequences may be targeted to a plastid. A preferred plastid is a chloroplast. Methods for targeting to plastids are well known in the art and include, but are not limited to, the use of transit peptides. Table 3 below shows examples of transit peptides suitable for targeting any fibrillin polypeptide to a plastid. The fibrillin polypeptide may not, in its natural form, be targeted to a plastid or may be targeted to a different plastid. Furthermore, the fibrillin may, in its natural form, be targeted to a plastid through a different transit peptide (for example, its natural transit peptide).

TABLE 3

Examples of transit peptide sequences useful in targeting amino acids to plastids

| NCBI Accession Number/SEQ ID NO | Source Organism | Protein Function | Transit Peptide Sequence |
| --- | --- | --- | --- |
| SEQ ID NO: 668 P07839 | *Chlamydomonas* | Ferredoxin | MAMAMRSTFAARVGAKPAVR GARPASRMSCMA |

TABLE 3-continued

Examples of transit peptide sequences useful in targeting amino acids to plastids

| NCBI Accession Number/SEQ ID NO | Source Organism | Protein Function | Transit Peptide Sequence |
|---|---|---|---|
| SEQ ID NO: 669 AAR23425 | Chlamydomonas | Rubisco activase | MQVTMKSSAVSGQRVGGARV ATRSVRRAQLQV |
| SEQ ID NO: 670 CAA56932 | Arabidopsis thaliana | asp Amino transferase | MASLMLSLGSTSLLPREINKDK LKLGTSASNPFLKAKSFSRVT MTVAVKPSR |
| SEQ ID NO: 671 CAA31991 | Arabidopsis thaliana | Acyl carrier protein1 | MATQFSASVSLQTSCLATTRIS FQKPALISNHGKTNLSFNLRR SIPSRRLSVSC |
| SEQ ID NO: 672 CAB63798 | Arabidopsis thaliana | Acyl carrier protein2 | MASIAASASISLQARPRQLAIA ASQVKSFSNGRRSSLSFNLRQ LPTRLTVSCAAKPETVDKVCA VVRKQL |
| SEQ ID NO: 673 CAB63799 | Arabidopsis thaliana | Acyl carrier protein3 | MASIATSASTSLQARPRQLVIG AKQVKSFSYGSRSNLSFNLRQ LPTRLTVYCAAKPETVDKVCA VVRKQLSLKE |

Nucleic acids encoding fibrillin polypeptides may be derived from any natural or artificial source. The nucleic acid may be modified from its native form in composition and/or genomic environment through deliberate human manipulation. Preferably the fibrillin polypeptide-encoding nucleic acid is from a plant, further preferably from a dicotyledonous plant, more preferably from the family Solanaceae, further preferably the nucleic acid is from the genus *Lycopersicon*, further preferably from the species *Lycopersicum*, most preferably from *Lycopersicon esculentum*.

Nucleic acids encoding PLATZ polypeptides may be derived from any natural or artificial source. The nucleic acid may be modified from its native form in composition and/or genomic environment through deliberate human manipulation. Preferably the PLATZ polypeptide-encoding nucleic acid is from a plant, further preferably from a dicotyledonous plant, more preferably from the family Salicaceae, most preferably the nucleic acid is from *Populus* sp.

Nucleic acids encoding PLST-like polypeptide may be derived from any natural or artificial source. The nucleic acid may be modified from its native form in composition and/or genomic environment through deliberate human manipulation. Preferably the PLST-like polypeptide-encoding nucleic acid is from a plant, further preferably from a dicocotyledonous plant, more preferably from the family Salicaceae, most preferably the nucleic acid is from *Populus trichocarpa*.

Nucleic acids encoding Glomalin polypeptides may be derived from any natural or artificial source. The nucleic acid may be modified from its native form in composition and/or genomic environment through deliberate human manipulation. Preferably the Glomalin polypeptide-encoding nucleic acid is from a plant, further preferably from a monocotyledonous plant, more preferably from the family Poaceae, most preferably the nucleic acid is from *Oryza sativa*.

Performance of the methods of the invention gives plants having enhanced yield-related traits. In particular performance of the methods of the invention gives plants having enhanced yield, especially increased seed yield relative to control plants. The terms "yield" and "seed yield" are described in more detail in the "definitions" section herein.

Reference herein to enhanced yield-related traits is taken to mean an increase in biomass (weight) of one or more parts of a plant, which may include aboveground (harvestable) parts and/or (harvestable) parts below ground. In particular, such harvestable parts are biomass and/or seeds, and performance of the methods of the invention results in plants having increased biomass and/or increased seed yield relative to the seed yield of control plants.

Taking corn as an example, a yield increase may be manifested as one or more of the following: increase in the number of plants established per square meter, an increase in the number of ears per plant, an increase in the number of rows, number of kernels per row, kernel weight, thousand kernel weight, ear length/diameter, increase in the seed filling rate (which is the number of filled seeds divided by the total number of seeds and multiplied by 100), among others.

Taking rice as an example, a yield increase may manifest itself as an increase in one or more of the following: number of plants per square meter, number of panicles per plant, number of spikelets per panicle, number of flowers (florets) per panicle (which is expressed as a ratio of the number of filled seeds over the number of primary panicles), increase in the seed filling rate (which is the number of filled seeds divided by the total number of seeds and multiplied by 100), increase in thousand kernel weight, among others.

The present invention provides a method for increasing yield, especially biomass and/or seed yield of plants, relative to control plants, which method comprises modulating expression in a plant and/or plant plastid of a nucleic acid encoding an eRF1 polypeptide, or a SCAMP-like polypeptide, or a fibrillin polypeptide, or a PLATZ polypeptide, or a PLST-like polypeptide, or a Glomalin polypeptide, as defined herein.

Since the transgenic plants according to the present invention have enhanced yield characteristics and/or yield, it is likely that these plants exhibit an increased growth rate (during at least part of their life cycle), relative to the growth rate of control plants at a corresponding stage in their life cycle.

The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced dry mature seeds, similar to the starting material. This life cycle may be influenced by factors such as speed of germination, early vigour, growth rate, greenness index, flowering time and speed of seed maturation. The increase in growth rate may take place at one or more stages in the life cycle of a plant or during substantially the whole plant life cycle. Increased growth rate during the early stages in the life cycle of a plant may reflect enhanced vigour. The increase in growth rate may alter the harvest cycle of a plant allowing plants to be sown later and/or harvested sooner than would otherwise be possible (a similar effect may be obtained with earlier flowering time). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soybean, potato or any other suitable plant). Harvesting additional times from the same rootstock in the case of some crop plants may also be possible. Altering the harvest cycle of a plant may lead to an increase in annual biomass production per square meter (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

According to a preferred feature of the present invention, performance of the methods of the invention gives plants having an increased growth rate relative to control plants. Therefore, according to the present invention, there is provided a method for increasing the growth rate of plants, which method comprises modulating expression in a plant of a nucleic acid encoding an eRF1 polypeptide as defined herein.

An increase in yield and/or growth rate occurs whether the plant is under non-stress conditions or whether the plant is exposed to various stresses compared to control plants. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35%, 30% or 25%, more preferably less than 20% or 15% in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. Mild stresses are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures. The abiotic stress may be an osmotic stress caused by a water stress (particularly due to drought), salt stress, oxidative stress or an ionic stress. Biotic stresses are typically those stresses caused by pathogens, such as bacteria, viruses, fungi, nematodes and insects. Biotic stresses are typically those stresses caused by pathogens, such as bacteria, viruses, fungi, nematodes, and insects. The term "non-stress" conditions as used herein are those environmental conditions that allow optimal growth of plants. Persons skilled in the art are aware of normal soil conditions and climatic conditions for a given location. The term non-stress conditions as used herein, encompasses the occasional or everyday mild stresses to which a plant is exposed, as defined herein, but does not encompass severe stresses.

In particular, the methods of the present invention may be performed under non-stress conditions or under conditions of mild drought to give plants having enhanced yield characteristics relative to control plants. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signalling pathways and cellular responses, such as the production of stress proteins, up-regulation of anti-oxidants, accumulation of compatible solutes and growth arrest. The term "non-stress" conditions as used herein are those environmental conditions that allow optimal growth of plants. Persons skilled in the art are aware of normal soil conditions and climatic conditions for a given location. Plants with optimal growth conditions, (grown under non-stress conditions) typically yield at least 97%, 95%, 92%, 90%, 87%, 85%, 83%, 80%, 77% or 75% of the average production of such plant in a given environment. Average production may be calculated on harvest and/or season basis. Persons skilled in the art are aware of average yield productions of a crop.

Performance of the methods of the invention gives plants grown under non-stress conditions or under mild drought conditions enhanced yield characteristics and/or yield relative to control plants grown under comparable conditions. Therefore, according to the present invention, there is provided a method for increasing yield in plants grown under non-stress conditions or under mild drought conditions, which method comprises modulating expression in a plant and/or plant plastid of a nucleic acid encoding an eRF1 polypeptide, or a SCAMP-like polypeptide, or a fibrillin polypeptide, or a PLATZ polypeptide, or a PLST-like polypeptide, or a Glomalin polypeptide.

Performance of the methods of the invention gives plants grown under conditions of nutrient deficiency, particularly under conditions of nitrogen deficiency, enhanced yield characteristics relative to control plants grown under comparable conditions. Therefore, according to the present invention, there is provided a method for increasing yield in plants grown under conditions of nutrient deficiency, which method comprises modulating expression in a plant of a nucleic acid encoding an eRF1 polypeptide, or a SCAMP-like polypeptide, or a fibrillin polypeptide, or a PLST-like polypeptide, or a Glomalin polypeptide. Nutrient deficiency may result from a lack of nutrients such as nitrogen, phosphates and other phosphorous-containing compounds, potassium, calcium, magnesium, manganese, iron and boron, amongst others.

Concerning PLATZ polypeptides, performance of the methods of the invention gives plants grown under conditions of nutrient deficiency, particularly under conditions of nitrogen deficiency, increased yield relative to control plants grown under comparable conditions. Because of the strong influence of nutrition utilization efficiency on plant yield and product quality, a huge amount of fertilizer is poured onto fields to optimize plant growth and quality. Productivity of plants ordinarily is limited by three primary nutrients, phosphorous, potassium and nitrogen, which is usually the rate-limiting element in plant growth of these three. Therefore the major nutritional element required for plant growth is nitrogen (N). It is a constituent of numerous important compounds found in living cells, including amino acids, proteins (enzymes), nucleic acids, and chlorophyll. 1.5% to 2% of plant dry matter is nitrogen and approximately 16% of total plant protein. Thus, nitrogen availability is a major limiting factor for crop plant growth and production (Frink et al. (1999) Proc Natl Acad Sci USA 96(4): 1175-1180), and has as well a major impact on protein accumulation and amino acid composition. Therefore, of great interest are crop plants with increased yield-related traits, when grown under nitrogen-limiting conditions. Thus, according to the present invention, there is provided a method for increasing yield in plants grown under conditions of nutrient deficiency, which method comprises modulating expression in a plant of a nucleic acid encoding a PLATZ polypeptide. Nutrient deficiency may result from a lack of nutrients such as nitrogen, phosphates and other phosphorous-containing compounds, potassium, calcium, magnesium, manganese, iron and boron, amongst others.

Performance of the methods of the invention gives plants grown under conditions of salt stress, enhanced yield characteristics relative to control plants grown under comparable conditions. Therefore, according to the present invention, there is provided a method for increasing yield in plants grown under conditions of salt stress, which method comprises modulating expression in a plant of a nucleic acid encoding an eRF1 polypeptide, or a SCAMP-like polypeptide, or a fibrillin polypeptide, or a PLATZ polypeptide, or a PLST-like polypeptide, or a Glomalin polypeptide. The term salt stress is not restricted to common salt (NaCl), but may be any one or more of: NaCl, KCl, LiCl, $MgCl_2$, $CaCl_2$, amongst others.

The present invention encompasses plants or parts thereof (including seeds) obtainable by the methods according to the present invention. The plants or parts thereof comprise a nucleic acid transgene encoding an eRF1 polypeptide, or a SCAMP-like polypeptide, or a fibrillin polypeptide, or a PLATZ polypeptide, or a PLST-like polypeptide, or a Glomalin polypeptide, as defined above.

The invention also provides genetic constructs and vectors to facilitate introduction and/or expression in plants of nucleic acids encoding an eRF1 polypeptide, or a SCAMP-like polypeptide, or a fibrillin polypeptide, or a PLATZ polypeptide, or a PLST-like polypeptide, or a Glomalin polypeptide. The gene constructs may be inserted into vectors, which may be commercially available, suitable for transforming into plants and suitable for expression of the gene of interest in the transformed cells. The invention also provides use of a gene construct as defined herein in the methods of the invention.

More specifically, the present invention provides a construct comprising:
(a) a nucleic acid encoding an eRF1 polypeptide, or a SCAMP-like polypeptide, or a fibrillin polypeptide, or a PLATZ polypeptide, or a PLST-like polypeptide, or a Glomalin polypeptide, as defined above;
(b) one or more control sequences capable of driving expression of the nucleic acid sequence of (a); and optionally
(c) a transcription termination sequence.

Preferably, the nucleic acid encoding an eRF1 polypeptide, or a SCAMP-like polypeptide, or a fibrillin polypeptide, or a PLATZ polypeptide, or a PLST-like polypeptide, or a Glomalin polypeptide, is as defined above. The term "control sequence" and "termination sequence" are as defined herein.

Plants are transformed with a vector comprising any of the nucleic acids described above. The skilled artisan is well aware of the genetic elements that must be present on the vector in order to successfully transform, select and propagate host cells containing the sequence of interest. The sequence of interest is operably linked to one or more control sequences (at least to a promoter).

Advantageously, any type of promoter, whether natural or synthetic, may be used to drive expression of the nucleic acid sequence, but preferably the promoter is of plant origin. A constitutive promoter is particularly useful in the methods. Preferably the constitutive promoter is also a ubiquitous promoter of medium strength. See the "Definitions" section herein for definitions of the various promoter types. Concerning eRF1 polypeptides and/or PLST-like polypeptides, also useful in the methods of the invention is a root-specific promoter.

Concerning Glomalin polypeptides, advantageously, any type of promoter, whether natural or synthetic, may be used to drive expression of the nucleic acid sequence, but preferably the promoter is of plant origin. See the "Definitions" section herein for definitions of the various promoter types. A root-specific promoter is particularly useful in the methods. The root-specific promoter is preferably an RCc3 promoter (Plant Mol Biol. 1995 January;27(2):237-48), more preferably the RCc3 promoter is from rice, further preferably the RCc3 promoter is represented by a nucleic acid sequence substantially similar to SEQ ID NO: 611, most preferably the promoter is as represented by SEQ ID NO: 611. Examples of other root-specific promoters which may also be used to perform the methods of the invention are shown in Table 2b in the "Definitions" section above.

Also useful in the methods of the invention is a constitutive promoter; preferably the constitutive promoter is a ubiquitous constitutive promoter of medium strength such as a GOS2 promoter, more preferably the promoter is the GOS2 promoter from rice. Further preferably the constitutive promoter is represented by a nucleic acid sequence substantially similar to SEQ ID NO: 612, most preferably the constitutive promoter is as represented by SEQ ID NO:

612. See the "Definitions" section herein for further examples of constitutive promoters.

Concerning eRF1 polypeptides, it should be clear that the applicability of the present invention is not restricted to the eRF1 polypeptide-encoding nucleic acid represented by SEQ ID NO: 1, nor is the applicability of the invention restricted to expression of an eRF1 polypeptide-encoding nucleic acid when driven by a constitutive promoter, or when driven by a root-specific promoter.

The constitutive promoter is preferably a medium strength promoter, more preferably selected from a plant derived promoter, such as a GOS2 promoter, more preferably is the promoter GOS2 promoter from rice. Further preferably the constitutive promoter is represented by a nucleic acid sequence substantially similar to SEQ ID NO: 85, most preferably the constitutive promoter is as represented by SEQ ID NO: 85. See the "Definitions" section herein for further examples of constitutive promoters.

Optionally, one or more terminator sequences may be used in the construct introduced into a plant. Preferably, the construct comprises an expression cassette comprising a GOS2 promoter, substantially similar to SEQ ID NO: 85, and the nucleic acid encoding the eRF1 polypeptide.

Concerning SCAMP-like polypeptides, it should be clear that the applicability of the present invention is not restricted to the SCAMP-like polypeptide-encoding nucleic acid represented by SEQ ID NO: 88, nor is the applicability of the invention restricted to expression of a SCAMP-like polypeptide-encoding nucleic acid when driven by a constitutive promoter.

The constitutive promoter is preferably a medium strength promoter, more preferably selected from a plant derived promoter, such as a GOS2 promoter, more preferably is the promoter GOS2 promoter from rice. Further preferably the constitutive promoter is represented by a nucleic acid sequence substantially similar to SEQ ID NO: 203, most preferably the constitutive promoter is as represented by SEQ ID NO: 203. See the "Definitions" section herein for further examples of constitutive promoters.

Optionally, one or more terminator sequences may be used in the construct introduced into a plant. Preferably, the construct comprises an expression cassette comprising a GOS2 promoter, substantially similar to SEQ ID NO: 203, and the nucleic acid encoding the SCAMP-LIKE polypeptide.

Concerning fibrillin polypeptides, it should be clear that the applicability of the present invention is not restricted to the fibrillin polypeptide-encoding nucleic acid represented by SEQ ID NO: 204, nor is the applicability of the invention restricted to expression of a fibrillin polypeptide-encoding nucleic acid when driven by a constitutive promoter.

The constitutive promoter is preferably a medium strength promoter, more preferably selected from a plant derived promoter, such as a GOS2 promoter, more preferably is the promoter GOS2 promoter from rice. Further preferably the constitutive promoter is represented by a nucleic acid sequence substantially similar to SEQ ID NO: 257, most preferably the constitutive promoter is as represented by SEQ ID NO: 257. See the "Definitions" section herein for further examples of constitutive promoters.

Optionally, one or more terminator sequences may be used in the construct introduced into a plant. Preferably, the construct comprises an expression cassette comprising a GOS2 promoter, substantially similar to SEQ ID NO: 257, and the nucleic acid encoding a fibrillin polypeptide.

Concerning PLATZ polypeptides, it should be clear that the applicability of the present invention is not restricted to the PLATZ polypeptide-encoding nucleic acid represented by SEQ ID NO: 260, nor is the applicability of the invention restricted to expression of a PLATZ polypeptide-encoding nucleic acid when driven by a constitutive promoter.

The constitutive promoter is preferably selected from a plant, such as a GOS2 promoter; more preferably the promoter is a GOS2 promoter from rice. Further preferably the constitutive promoter is represented by a nucleic acid sequence substantially similar to SEQ ID NO: 273, most preferably the constitutive promoter is as represented by SEQ ID NO: 273. See the "Definitions" section herein for further examples of constitutive promoters.

Optionally, one or more terminator sequences may be used in the construct introduced into a plant. Preferably, the construct comprises an expression cassette comprising a GOS2 promoter, substantially similar to SEQ ID NO: 273, and the nucleic acid encoding the PLATZ polypeptide.

Concerning PLST-like polypeptides, it should be clear that the applicability of the present invention is not restricted to the PLST-like polypeptide-encoding nucleic acid represented by SEQ ID NO: 410, nor is the applicability of the invention restricted to expression of a PLST-like polypeptide-encoding nucleic acid when driven by a constitutive promoter.

The constitutive promoter is preferably a medium strength promoter, more preferably selected from a plant derived promoter, such as a GOS2 promoter, more preferably is the promoter GOS2 promoter from rice. Further preferably the constitutive promoter is represented by a nucleic acid sequence substantially similar to SEQ ID NO: 542, most preferably the constitutive promoter is as represented by SEQ ID NO: 542. See the "Definitions" section herein for further examples of constitutive promoters.

Optionally, one or more terminator sequences may be used in the construct introduced into a plant. Preferably, the construct comprises an expression cassette comprising a GOS2 promoter, substantially similar to SEQ ID NO: 542, and the nucleic acid encoding the PLST-like polypeptide.

Concerning Glomalin polypeptides, it should be clear that the applicability of the present invention is not restricted to the Glomalin polypeptide-encoding nucleic acid represented by SEQ ID NO: 545, nor is the applicability of the invention restricted to expression of a Glomalin polypeptide-encoding nucleic acid when driven by a root-specific promoter, or when driven by a constitutive promoter.

Optionally, one or more terminator sequences may be used in the construct introduced into a plant. Preferably, the construct comprises an expression cassette comprising a RCc3 promoter, substantially similar to SEQ ID NO: 611, and the nucleic acid encoding the Glomalin polypeptide.

According to a preferred feature of the invention, the modulated expression is increased expression. Methods for increasing expression of nucleic acids or genes, or gene products, are well documented in the art and examples are provided in the definitions section.

Additional regulatory elements may include transcriptional as well as translational enhancers. Those skilled in the art will be aware of terminator and enhancer sequences that may be suitable for use in performing the invention. An intron sequence may also be added to the 5' untranslated region (UTR) or in the coding sequence to increase the amount of the mature message that accumulates in the cytosol, as described in the definitions section. Other control sequences (besides promoter, enhancer, silencer, intron sequences, 3'UTR and/or 5'UTR regions) may be protein and/or RNA stabilizing elements. Such sequences would be known or may readily be obtained by a person skilled in the art.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

For the detection of the successful transfer of the nucleic acid sequences as used in the methods of the invention and/or selection of transgenic plants comprising these nucleic acids, it is advantageous to use marker genes (or reporter genes). Therefore, the genetic construct may optionally comprise a selectable marker gene. Selectable markers are described in more detail in the "definitions" section herein. The marker genes may be removed or excised from the transgenic cell once they are no longer needed. Techniques for marker removal are known in the art, useful techniques are described above in the definitions section.

The invention also provides a method for the production of transgenic plants having enhanced yield-related traits relative to control plants, comprising introduction and expression in a plant and/or a plant plastid of any nucleic acid encoding an eRF1 polypeptide, or a SCAMP-like polypeptide, or a fibrillin polypeptide, or a PLATZ polypeptide, or a PLST-like polypeptide, or a Glomalin polypeptide, as defined hereinabove.

More specifically, the present invention provides a method for the production of transgenic plants having enhanced yield-related traits, particularly increased seed yield and also biomass, which method comprises:

(i) introducing and expressing in a plant or plant cell a nucleic acid encoding an eRF1 polypeptide, or a SCAMP-like polypeptide, or a fibrillin polypeptide, or a PLATZ polypeptide, or a PLST-like polypeptide, or a Glomalin polypeptide; and (ii) cultivating the plant cell under conditions promoting plant growth and development.

The nucleic acid of (i) may be any of the nucleic acids capable of encoding an eRF1 polypeptide, or a SCAMP-like polypeptide, or a fibrillin polypeptide, or a PLATZ polypeptide, or a PLST-like polypeptide, or a Glomalin polypeptide, as defined herein.

The nucleic acid may be introduced directly into a plant cell or into the plant itself (including introduction into a tissue, organ or any other part of a plant). According to a preferred feature of the present invention, the nucleic acid is preferably introduced into a plant by transformation. The term "transformation" is described in more detail in the "definitions" section herein.

The genetically modified plant cells can be regenerated via all methods with which the skilled worker is familiar. Suitable methods can be found in the above-mentioned publications by S. D. Kung and R. Wu, Potrykus or Höfgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques. The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated nucleic acid encoding an eRF1 polypeptide, or a SCAMP-like polypeptide, or a fibrillin polypeptide, or a PLATZ polypeptide, or a PLST-like polypeptide, or a Glomalin polypeptide, as defined hereinabove. Preferred host cells according to the invention are plant cells. Host plants for the nucleic acids or the vector used in the method according to the invention, the expression cassette or construct or vector are, in principle, advantageously all plants, which are capable of synthesizing the polypeptides used in the inventive method.

The methods of the invention are advantageously applicable to any plant. Plants that are particularly useful in the methods of the invention include all plants which belong to the superfamily Viridiplantae, in particular monocotyledonous and dicotyledonous plants including fodder or forage legumes, ornamental plants, food crops, trees or shrubs. According to a preferred embodiment of the present invention, the plant is a crop plant. Examples of crop plants include soybean, sunflower, canola, alfalfa, rapeseed, linseed, cotton, tomato, potato and tobacco. Further preferably, the plant is a monocotyledonous plant. Examples of monocotyledonous plants include sugarcane. More preferably the plant is a cereal. Examples of cereals include rice, maize, wheat, barley, millet, rye, triticale, sorghum, emmer, spelt, secale, einkorn, teff, milo and oats.

The invention also extends to harvestable parts of a plant such as, but not limited to seeds, leaves, fruits, flowers, stems, roots, rhizomes, tubers and bulbs, which harvestable parts comprise a recombinant nucleic acid encoding an eRF1 polypeptide, or a SCAMP-like polypeptide, or a fibrillin polypeptide, or a PLATZ polypeptide, or a PLST-like polypeptide, or a Glomalin polypeptide. The invention furthermore relates to products derived, preferably directly derived, from a harvestable part of such a plant, such as dry pellets or powders, oil, fat and fatty acids, starch or proteins.

According to a preferred feature of the invention, the modulated expression is increased expression. Methods for increasing expression of nucleic acids or genes, or gene products, are well documented in the art and examples are provided in the definitions section.

As mentioned above, a preferred method for modulating expression of a nucleic acid encoding an eRF1 polypeptide, or a SCAMP-like polypeptide, or a fibrillin polypeptide, or a PLATZ polypeptide, or a PLST-like polypeptide, or a Glomalin polypeptide, is by introducing and expressing in a plant a nucleic acid encoding an eRF1 polypeptide, or a SCAMP-like polypeptide, or a fibrillin polypeptide, or a PLATZ polypeptide, or a PLST-like polypeptide, or a Glomalin polypeptide; however the effects of performing the method, i.e. enhancing yield-related traits may also be achieved using other well known techniques, including but not limited to T-DNA activation tagging, TILLING, homologous recombination. A description of these techniques is provided in the definitions section.

The present invention also encompasses use of nucleic acids encoding eRF1 polypeptide as described herein and use of these eRF1 polypeptides, or SCAMP-like polypeptides, or fibrillin polypeptides, or PLATZ polypeptides, or PLST-like polypeptides, or Glomalin polypeptides, in enhancing any of the aforementioned yield-related traits in plants.

Nucleic acids encoding an eRF1 polypeptide, or a SCAMP-like polypeptide, or a fibrillin polypeptide, or a PLATZ polypeptide, or a PLST-like polypeptide, or a Glomalin polypeptide, described herein, or the eRF1 polypeptides, or SCAMP-like polypeptides, or fibrillin polypeptides, or PLATZ polypeptides, or PLST-like polypeptides, or Glomalin polypeptides, themselves, may find use in breeding programmes in which a DNA marker is identified which may be genetically linked to a gene encoding an eRF1 polypeptide, or a SCAMP-like polypeptide, or a fibrillin polypeptide, or a PLATZ polypeptide, or a PLST-like polypeptide, or a Glomalin polypeptide. The nucleic acids/genes, or the eRF1 polypeptides, or SCAMP-like polypeptides, or fibrillin polypeptides, or PLATZ polypeptides, or PLST-like polypeptides, or Glomalin polypeptides, themselves may be used to define a molecular marker. This DNA or protein marker may then be used in breeding programmes to select plants having enhanced yield-related traits as defined hereinabove in the methods of the invention.

Allelic variants of a nucleic acid/gene encoding an eRF1 polypeptide, or a SCAMP-like polypeptide, or a fibrillin polypeptide, or a PLATZ polypeptide, or a PLST-like polypeptide, or a Glomalin polypeptide, may also find use in marker-assisted breeding programmes. Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give enhanced yield characteristics. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Nucleic acids encoding an eRF1 polypeptide, or a SCAMP-like polypeptide, or a fibrillin polypeptide, or a PLATZ polypeptide, or a PLST-like polypeptide, or a Glomalin polypeptide, may also be used as probes for genetically and physically mapping the genes that they are a part of, and as markers for traits linked to those genes. Such information may be useful in plant breeding in order to develop lines with desired phenotypes. Such use of nucleic acids encoding an eRF1 polypeptide, or a SCAMP-like polypeptide, or a fibrillin polypeptide, or a PLATZ polypeptide, or a PLST-like polypeptide, or a Glomalin polypeptide, requires only a nucleic acid sequence of at least 15 nucleotides in length. The nucleic acids encoding an eRF1 polypeptide, or a SCAMP-like polypeptide, or a fibrillin polypeptide, or a PLATZ polypeptide, or a PLST-like polypeptide, or a Glomalin polypeptide, may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the nucleic acids encoding an eRF1 polypeptide, or a SCAMP-like polypeptide, or a fibrillin polypeptide, or a PLATZ polypeptide, or a PLST-like polypeptide, or a Glomalin polypeptide. The resulting banding patterns may then be subjected to genetic analyses using computer programs such as MapMaker (Lander et al. (1987) Genomics 1: 174-181) in order to construct a genetic map. In addition, the nucleic acids may be used to probe Southern blots containing restriction endonuclease-treated genomic DNAs of a set of individuals representing parent and progeny of a defined genetic cross. Segregation of the DNA polymorphisms is noted and used to calculate the position of the nucleic acid encoding an eRF1 polypeptide, or a SCAMP-like polypeptide, or a fibrillin polypeptide, or a PLATZ polypeptide, or a PLST-like polypeptide, or a Glomalin polypeptide, in the genetic map previously obtained using this population (Botstein et al. (1980) Am. J. Hum. Genet. 32:314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridisation (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acids. Examples include allele-specific amplification (Kazazian (1989) J. Lab. Clin. Med 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al. (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

The methods according to the present invention result in plants having enhanced yield-related traits, as described hereinbefore. These traits may also be combined with other economically advantageous traits, such as further yield-enhancing traits, tolerance to other abiotic and biotic stresses, traits modifying various architectural features and/or biochemical and/or physiological features.

Items 1. eRF1 Polypeptides

In one aspect, the present invention is characterised by one or more of the following items:

1. A method for enhancing yield-related traits in plants relative to control plants, comprising modulating expression in a plant of a nucleic acid encoding a eRF1 polypeptide, wherein said polypeptide comprises at least three consensus domains, eRF1 domain 1, eRF1 domain 2 and eRF1 domain 3, with PFam accession numbers respectively PF03463, PF03464 and PF03465.
2. Method according to item 1, wherein the eRF1 domain 1 of an eRF1 polypeptide has at least, in increasing order of preference, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the sequence located between amino acid 6 and 140 of SEQ ID NO 2.
3. Method according to item 1, wherein the eRF1 domain 2 of an eRF1 polypeptide has at least, in increasing order of preference, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the sequence located between amino acid 144 and 278 of SEQ ID NO 2.
4. Method according to item 1, wherein the eRF1 domain 3 of an eRF1 polypeptide has at least, in increasing order of preference, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the sequence located between amino acid 281 and 418 of SEQ ID NO 2.
5. Method according to any of the items 1 to 4 wherein the eRF1 polypeptide of the present invention comprises one or more of the following peptides: GGQ, NIKS and [GA][IMLV]LR[YW] having SEQ ID NO: 73, 74 and 75 respectively.
6. Method according to item 1, wherein said eRF1 polypeptide may also comprise sequence motifs having at least, in increasing order of preference 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to anyone of the following motifs:

```
(i)
Motif 1:
                                        (SEQ ID NO: 76)
FGTLSGNTREVLHKF[TS]VDLPKKHGRGGQSALRFARLRMEKRHNY

VRK[TV]AE, (ii)
Motif 2:
                                        (SEQ ID NO: 77)
YN[KR]VPPNGLVLY[TC]GT[IV]VT[ED][DE]GKEKKV[TN]IDFE

PF[KR]PIN[AT]SLYLCDNKFHTE, (iii)
Motif 3:
                                        (SEQ ID NO: 78)
ARGNGTSMISLI[MI]PP[RK]DQ[IV]SRVTKML[GA]DE[YF]GTAS

NI KSRVNR[QL]SVL[GS]AIT
```

7. Method, according to item 1 or 6, wherein said eRF1 polypeptide may also comprise any one or more sequence motifs having at least, in increasing order of preference 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to anyone of the following motifs:

```
(i)
Motif 4:
                                        (SEQ ID NO: 79)
[TS]VDLPKKHGRGGQSALRFARLR[EM]EKRHNYVRKVAE[VL]A[VT]

QNFITND[KR][PV]NV, (ii)
Motif 5:
                                        (SEQ ID NO: 80)
Y[NT][KR]VPPNGLV[VLI]YCG[TD][IV][ILM]T[ED][ED]GKE

[KR]K[VM][NT]ID[FI]EPFKPINTSLYLCDNKFHTE, (iii)
Motif 6:
                                        (SEQ ID NO: 81)
ARGNGTSMISL[IV][IM]PPK[DG]Q[IV]S[RL]V[QA]KML[AT]

[DE]EYGTASNIKSRVNR[LQ]SVL[SG]AIT
```

8. Method, according to any of the items 6 to 7, wherein said eRF1 polypeptide may also comprise any one or more of the following sequence motifs having at least, in increasing order of preference 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to anyone of the following motifs:

(i)
Motif 7:
(SEQ ID NO: 82)
VDLPKKHGR<u>GGQ</u>SALRFARLRMEKRHNYVRKTAELATQF[YF]INPAT

SQPNV, (ii)
Motif 8:
(SEQ ID NO: 83)
YNKVPPNGLVLYTGTIVT[ED]DGKEKKVTIDFEPF[KR]PINASLYLC

DNKFHTE, (iii)
Motif 9:
(SEQ ID NO: 84)
TSMISLIMPPRDQ[VI]SRVTKMLGDE[FY]GTAS<u>NIKS</u>RVNRQSVLGA

ITSAQQR.

9. Method, according to any of the items 1 to 8, wherein the homologue of eRF1 polypeptide has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 7%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by any of the polypeptides of Table A1, preferably by the SEQ ID NO: 2.

10. Method, according to any of the items 1 to 9, wherein said modulated expression is effected by introducing and expressing in a plant a nucleic acid encoding an eRF1 polypeptide as defined in any of the previous items.

11. Method according to any one of items 1 to 10, wherein said nucleic acid encoding an eRF1 polypeptide encodes any one of the proteins listed in Table A1 or is a portion of such a nucleic acid, or a nucleic acid capable of hybridising with such a nucleic acid.

12. Method according to any one of items 1 to 11, wherein said nucleic acid sequence encodes an orthologue or paralogue of any of the proteins given in Table A1.

13. Method according to any preceding item, wherein said enhanced yield-related traits comprise increased yield, preferably increased biomass and/or increased seed yield relative to control plants.

14. Method according to any one of items 1 to 13, wherein said enhanced yield-related traits are obtained under non-stress conditions.

15. Method according to any one of items 1 to 14, wherein said enhanced yield-related traits are obtained under conditions of drought stress, salt stress or nitrogen deficiency.

16. Method according to any one of items 10 to 12, wherein said nucleic acid is operably linked to a constitutive promoter, preferably to a GOS2 promoter, most preferably to a GOS2 promoter from rice.

17. Method according to any one of items 1 to 16, wherein said nucleic acid encoding an eRF1 polypeptide is of plant origin, preferably from a dicotyledonous plant, further preferably from the family Brassicaceae, more preferably from the genus *Arabidopsis*, most preferably from *Arabidopsis thaliana*.

18. Plant or part thereof, including seeds, obtainable by a method according to any one of items 1 to 17, wherein said plant or part thereof comprises a recombinant nucleic acid encoding an eRF1 polypeptide.

19. Construct comprising:
    (i) nucleic acid encoding an eRF1 polypeptide as defined in items 1 to 9;
    (ii) one or more control sequences capable of driving expression of the nucleic acid sequence of (i); and optionally
    (iii) a transcription termination sequence.

20. Construct according to item 19, wherein one of said control sequences is a constitutive promoter, preferably a GOS2 promoter, most preferably a GOS2 promoter from rice.

21. Use of a construct according to items 19 or 20 in a method for making plants having increased yield, particularly increased biomass and/or increased seed yield relative to control plants.

22. Plant, plant part or plant cell transformed with a construct according to items 19 or 20.

23. Method for the production of a transgenic plant having increased yield, particularly increased biomass and/or increased seed yield relative to control plants, comprising:
    (i) introducing and expressing in a plant a nucleic acid encoding an eRF1 polypeptide as defined in items 1 to 9; and
    (ii) cultivating the plant cell under conditions promoting plant growth and development.

24. Transgenic plant having increased yield, particularly increased biomass and/or increased seed yield, relative to control plants, resulting from modulated expression of a nucleic acid encoding an eRF1 polypeptide as defined in items 1 to 9, or a transgenic plant cell derived from said transgenic plant.

25. Transgenic plant according to item 18, 22 or 24, or a transgenic plant cell derived thereof, wherein said plant is a crop plant or a monocot or a cereal, such as rice, maize, wheat, barley, millet, rye, triticale, sorghum emmer, spelt, secale, einkorn, teff, milo and oats.

26. Harvestable parts of a plant according to item 25, wherein said harvestable parts are preferably shoot biomass and/or seeds.

27. Products derived from a plant according to item 25 and/or from harvestable parts of a plant according to item 26.

28. Use of a nucleic acid encoding an eRF1 polypeptide in enhancing yield characteristics, particularly in increasing seed yield and/or shoot biomass in plants, relative to control plants.

29. An isolated nucleic acid molecule selected from:
    (i) a nucleic acid represented by any one of the following nucleic acid sequences: G.max_GM06MC33657_sm55b10@32878 having SEQ ID NO: 15; H.vulgare_c64960768hv270303@2598 having SEQ ID NO: 17;
    (ii) the complement of a nucleic acid represented by said sequences G.max_GM06MC33657_sm55b10@32878 having SEQ ID NO: 15; H.vulgare_c64960768hv270303@2598 having SEQ ID NO 17;
(iii) a nucleic acid encoding the polypeptide as represented by any one SEQ ID NO: 16; SEQ ID NO 18 preferably as a result of the degeneracy of the genetic code, said isolated nucleic acid can be derived from a polypeptide sequence as represented by any one of SEQ ID NO: 16 and 18 and further preferably confers enhanced yield-related traits relative to control plants;
(iv) a nucleic acid having, in increasing order of preference at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity with any of the nucleic acid sequences of Table A1 and further preferably conferring enhanced yield-related traits relative to control plants;
(v) a nucleic acid molecule which hybridizes with a nucleic acid molecule of (i) to (iv) under stringent hybridization conditions and preferably confers enhanced yield-related traits relative to control plants;
(vi) a nucleic acid encoding a eRF1 polypeptide having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 16, and 18 and any of the other amino acid sequences in Table A1 and preferably conferring enhanced yield-related traits relative to control plants.

30. According to a further embodiment of the present invention, there is also provided an isolated polypeptide selected from:
(i) an amino acid sequence represented by any one of SEQ ID NO: 16 and 18;
(ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 16 and 18 and any of the other amino acid sequences in Table A1 and preferably conferring enhanced yield-related traits relative to control plants.
(iii) derivatives of any of the amino acid sequences given in (i) or (ii) above.

2. SCAMP-Like Polypeptides

In another aspect, the invention is characterised by one or more of the following items:
1. A method for enhancing yield-related traits in plants relative to control plants, comprising modulating expression in a plant of a nucleic acid encoding a SCAMP-like polypeptide, wherein said SCAMP-like polypeptide comprises a SCAMP domain.
2. Method according to item 1, wherein said SCAMP domain has in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to the amino acid of the SCAMP domain present in any of the polypeptides of Table A2, preferably to the SCAMP domain represented by the sequence located between amino acids 91 and 265 of SEQ ID NO: 89.
3. Method according to item 1 or 2, wherein said modulated expression is effected by introducing and expressing in a plant a nucleic acid encoding a SCAMP-like polypeptide.
4. Method according to any one of items 1 to 3, wherein said nucleic acid encoding a SCAMP-like polypeptide encodes any one of the proteins listed in Table A2 or is a portion of such a nucleic acid, or a nucleic acid capable of hybridising with such a nucleic acid.
5. Method according to any one of items 1 to 4, wherein said nucleic acid sequence encodes an orthologue or paralogue of any of the proteins given in Table A2.
6. Method according to any preceding item, wherein said enhanced yield-related traits comprise increased yield, preferably increased biomass and/or increased seed yield relative to control plants.
7. Method according to any one of items 1 to 6, wherein said enhanced yield-related traits are obtained under non-stress conditions.
8. Method according to any one of items 1 to 6, wherein said enhanced yield-related traits are obtained under conditions of drought stress, salt stress or nitrogen deficiency.
9. Method according to any one of items 3 to 8, wherein said nucleic acid is operably linked to a constitutive promoter, preferably to a GOS2 promoter, most preferably to a GOS2 promoter from rice.
10. Method according to any one of items 1 to 9, wherein said nucleic acid encoding a LBD polypeptide is of plant origin, preferably from a dicotyledonous plant, further preferably from the family Brassicaceae, more preferably from the genus *Arabidopsis*, most preferably from *Arabidopsis thaliana*.
11. Plant or part thereof, including seeds, obtainable by a method according to any one of items 1 to 10, wherein said plant or part thereof comprises a recombinant nucleic acid encoding a SCAMP-like polypeptide.
12. Construct comprising:
(i) nucleic acid encoding a SCAMP-like polypeptide as defined in items 1 or 2;
(ii) one or more control sequences capable of driving expression of the nucleic acid sequence of (i); and optionally
(iii) a transcription termination sequence.
13. Construct according to item 12, wherein one of said control sequences is a constitutive promoter, preferably a GOS2 promoter, most preferably a GOS2 promoter from rice.
14. Use of a construct according to item 12 or 13 in a method for making plants having increased yield, particularly increased biomass and/or increased seed yield relative to control plants.
15. Plant, plant part or plant cell transformed with a construct according to item 12 or 13.
16. Method for the production of a transgenic plant having increased yield, particularly increased biomass and/or increased seed yield relative to control plants, comprising:
(i) introducing and expressing in a plant a nucleic acid encoding a SCAMP-like polypeptide as defined in item 1 or 2; and
(ii) cultivating the plant cell under conditions promoting plant growth and development.
17. Transgenic plant having increased yield, particularly increased biomass and/or increased seed yield, relative to control plants, resulting from modulated expression of a nucleic acid encoding a SCAMP-like polypeptide as defined in item 1 or 2, or a transgenic plant cell derived from said transgenic plant.

18. Transgenic plant according to item 11, 15 or 17, or a transgenic plant cell derived thereof, wherein said plant is a crop plant or a monocot or a cereal, such as rice, maize, wheat, barley, millet, rye, triticale, sorghum emmer, spelt, secale, einkorn, teff, milo and oats.

19. Harvestable parts of a plant according to item 18, wherein said harvestable parts are preferably shoot biomass and/or seeds.

20. Products derived from a plant according to item 18 and/or from harvestable parts of a plant according to item 19.

21. Use of a nucleic acid encoding a SCAMP-like polypeptide in increasing yield, particularly in increasing seed yield and/or shoot biomass in plants, relative to control plants.

22. An isolated nucleic acid molecule selected from:
    (i) a nucleic acid represented by any one of SEQ ID NO: 100, 102, 104, 106, 180, 182, 184, 186, 188, 190 and 192;
    (ii) the complement of a nucleic acid represented by any one of (i) SEQ ID NO: 100, 102, 104, 106, 180, 182, 184, 186, 188, 190 and 192;
    (iii) a nucleic acid encoding the polypeptide as represented by any one of SEQ ID NO: 101, 103, 105, 107, 109, 183, 185, 187, 189, 191 and 193 preferably as a result of the degeneracy of the genetic code, said isolated nucleic acid can be derived from a polypeptide sequence as represented by any one of SEQ ID NO: 101, 103, 105, 107, 181, 183, 185, 187, 189, 191 and 193 and further preferably confers enhanced yield-related traits relative to control plants;
    (iv) a nucleic acid having, in increasing order of preference at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity with any of the nucleic acid sequences of Table A2 and further preferably conferring enhanced yield-related traits relative to control plants;
    (v) a nucleic acid molecule which hybridizes with a nucleic acid molecule of (i) to (iv) under stringent hybridization conditions and preferably confers enhanced yield-related traits relative to control plants;
    (vi) a nucleic acid encoding a polypeptide having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 101, 103, 105, 107, 181, 183, 185, 187, 189, 191 and 193 and any of the other amino acid sequences in Table A2 and preferably conferring enhanced yield-related traits relative to control plants.

23. An isolated polypeptide selected from:
    (i) an amino acid sequence represented by any one of SEQ ID NO: 101, 103, 105, 107, 181, 183, 185, 187, 189, 191 and 193;
    (ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 101, 103, 105, 107, 181, 183, 185, 187, 189, 191 and 193 and any of the other amino acid sequences in Table A2 and preferably conferring enhanced yield-related traits relative to control plants.
    (iii) derivatives of any of the amino acid sequences given in (i) or (ii) above.

3. Fibrillin Polypeptides

In another aspect, the invention is characterised by one or more of the following items:

1. A method for enhancing yield-related traits in plants relative to control plants, comprising modulating expression in a plant of a nucleic acid encoding a fibrillin polypeptide, comprising:
    (i) a PAP fibrillin domain as represented by PFAM Accession number PF04755; and
    (ii) a C-terminal domain represented by KFECQNESRG-GLVRNVIKWSVPRLLE ENEGATLIVTARFSS-VSARNIYLKFEEIGLQNINISDDLQAVIAPAILPRS-FLSLQIL QFIRSFKARVPVTSPERHSVGGLYYLSYLDKN-MLLGRAVGGGGVFIFTRAHTL (SEQ ID NO: 253) which may contain between 0 and 5 gaps representing between 1 and 15 residues, or a domain having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to (SEQ ID NO: 253); and optionally
    (iii) a transit peptide within the N-terminal region of the polypeptide.

2. Method according to item 1, wherein said PAP fibrillin domain is represented by: ENRKYELLNIIQDTQR-GLVTTADQRSTIEEAMVVVEGFDAGKEIDL-SKLDGTWQYTS APDVLILFESAARLPFFQVGQIFQ SEQ ID NO: 252 which may contain between 0 and 5 gaps representing between 1 and 15 residues, or a domain having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to SEQ ID NO: 252.

3. Method according to item 1 or 2, wherein said fibrillin polypeptide comprises one or more of the following one or more of the following domains:
    Domain X: NIYLQF[EQ]E[IA]S[VL]Q[ND]INISE[EQ] LQAL[IL]APA[IL]LPRSFL [SN]LQILQ[FA][LI][RK] [TS]F[KR]AQ[VI]P;
    Domain Y: YYL[ST]YLD[RN][ND]MLLGR[AS] VGGGGV;

Domain Z: [PA][IL]DL[AS]KLDGTWRLQYTSA[SP]DV; or a domain having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to any one or more of Domains X, Y and Z.

4. Method according to any one of items 1 to 3, wherein said modulated expression is effected by introducing and expressing in a plant a nucleic acid encoding a fibrillin polypeptide.

5. Method according to any one of items 1 to 4, wherein said nucleic acid encoding a fibrillin polypeptide encodes any one of the proteins listed in Table A3 or is a portion of such a nucleic acid, or a nucleic acid capable of hybridising with such a nucleic acid.

6. Method according to any one of items 1 to 5, wherein said nucleic acid sequence encodes an orthologue or paralogue of any of the proteins given in Table A3.

7. Method according to any preceding item, wherein said enhanced yield-related traits comprise increased yield, preferably seed yield relative to control plants.

8. Method according to any one of items 1 to 7, wherein said enhanced yield-related traits are obtained under non-stress conditions.

9. Method according to any one of items 4 to 8, wherein said nucleic acid is operably linked to a constitutive promoter, preferably to a GOS2 promoter, most preferably to a GOS2 promoter from rice.

10. Method according to any one of items 1 to 9, wherein said nucleic acid encoding a fibrillin polypeptide is of plant origin, preferably from a dicotyledonous plant, further preferably from the family more preferably from the family Solanaceae, further preferably the nucleic acid is from the genus *Lycopersicon*, further preferably from the species *Lycopersicum*, most preferably from *Lycopersicon esculentum*.

11. Plant or part thereof, including seeds, obtainable by a method according to any one of items 1 to 10, wherein said plant or part thereof comprises a recombinant nucleic acid encoding a fibrillin polypeptide.

12. Construct comprising:
   (i) nucleic acid encoding a fibrillin polypeptide as defined in any one of items 1 to 3;
   (ii) one or more control sequences capable of driving expression of the nucleic acid sequence of (i); and optionally
   (iii) a transcription termination sequence.

13. Construct according to item 12, wherein one of said control sequences is a constitutive promoter, preferably a GOS2 promoter, most preferably a GOS2 promoter from rice.

14. Use of a construct according to item 12 or 13 in a method for making plants having increased yield, particularly increased seed yield relative to control plants.

15. Plant, plant part or plant cell transformed with a construct according to item 12 or 13.

16. Method for the production of a transgenic plant having increased yield, particularly increased biomass and/or increased seed yield relative to control plants, comprising:
   (i) introducing and expressing in a plant a nucleic acid encoding a fibrillin polypeptide as defined in any one of items 1 to 3; and
   (ii) cultivating the plant cell under conditions promoting plant growth and development.

17. Transgenic plant having increased yield, particularly increased seed yield, relative to control plants, resulting from modulated expression of a nucleic acid encoding a fibrillin polypeptide as defined in any one of items 1 to 3, or a transgenic plant cell derived from said transgenic plant.

18. Transgenic plant according to item 11, 15 or 17, or a transgenic plant cell derived thereof, wherein said plant is a crop plant or a monocot or a cereal, such as rice, maize, wheat, barley, millet, rye, triticale, sorghum, emmer, spelt, secale, einkorn, teff, milo and oats.

19. Harvestable parts of a plant according to item 18, wherein said harvestable parts are preferably seeds.

20. Products derived from a plant according to item 18 and/or from harvestable parts of a plant according to item 19.

21. Use of a nucleic acid encoding a fibrillin polypeptide in increasing yield, particularly in increasing seed yield relative to control plants.

22. An isolated nucleic acid molecule selected from:
   (i) a nucleic acid represented by any one of the following nucleic acid sequences: B.napus_BN06MC20042_46499279@19975 having SEQ ID NO: 206; G.max_GM06MC19234_59694709@18873 having SEQ ID NO: 220;
   (ii) the complement of a nucleic acid represented by said sequences B.napus_BN06MC20042_46499279@19975 having SEQ ID NO: 206; G.max_GM06MC19234_59694709@18873 having SEQ ID NO 220;
   (iii) a nucleic acid encoding the polypeptide as represented by any one SEQ ID NO: 207; SEQ ID NO 221 preferably as a result of the degeneracy of the genetic code, said isolated nucleic acid can be derived from a polypeptide sequence as represented by any one of SEQ ID NO: 207 and 221 and further preferably confers enhanced yield-related traits relative to control plants;
   (iv) a nucleic acid having, in increasing order of preference at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity with any of the nucleic acid sequences of Table A3 and further preferably conferring enhanced yield-related traits relative to control plants;
   (v) a nucleic acid molecule which hybridizes with a nucleic acid molecule of (i) to (iv) under stringent hybridization conditions and preferably confers enhanced yield-related traits relative to control plants;
   (vi) a nucleic acid encoding a fibrillin polypeptide having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 207, and 221 and any of the other amino acid sequences in Table A3 and preferably conferring enhanced yield-related traits relative to control plants.

23. According to a further embodiment of the present invention, there is also provided an isolated polypeptide selected from:
   (i) an amino acid sequence represented by any one of SEQ ID NO: 207 and 221;
   (ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 207 and 221 and any of the other amino acid sequences in Table A3 and preferably conferring enhanced yield-related traits relative to control plants.
   (iii) derivatives of any of the amino acid sequences given in (i) or (ii) above.

4. PLATZ Polypeptides

In another aspect, the invention is characterised by one or more of the following items:

1. A method for enhancing yield-related traits in plants relative to control plants, comprising modulating expression in a plant of a nucleic acid encoding a PLATZ polypeptide, wherein said PLATZ polypeptide comprises a PLATZ domain.
2. Method according to item 1, wherein said PLATZ polypeptide comprises one or more of the motifs 10 to 18 (SEQ ID NO: 264 to SEQ ID NO: 272)
3. Method according to item 1 or 2, wherein said modulated expression is effected by introducing and expressing in a plant a nucleic acid encoding a PLATZ polypeptide.
4. Method according to any one of items 1 to 3, wherein said nucleic acid encoding a PLATZ polypeptide encodes any one of the proteins listed in Table A4 or is a portion of such a nucleic acid, or a nucleic acid capable of hybridising with such a nucleic acid.
5. Method according to any one of items 1 to 4, wherein said nucleic acid sequence encodes an orthologue or paralogue of any of the proteins given in Table A4.
6. Method according to any preceding item, wherein said enhanced yield-related traits comprise increased yield, preferably increased biomass and/or increased seed yield relative to control plants.
7. Method according to any one of items 1 to 6, wherein said enhanced yield-related traits are obtained under non-stress conditions.
8. Method according to any one of items 3 to 7, wherein said nucleic acid is operably linked to a constitutive promoter, preferably to a GOS2 promoter, most preferably to a GOS2 promoter from rice.
9. Method according to any one of items 1 to 8, wherein said nucleic acid encoding a PLATZ polypeptide is of plant origin, preferably from a dicotyledonous plant, further preferably from the family Salicaceae, more preferably from the genus *Populus*.
10. Plant or part thereof, including seeds, obtainable by a method according to any one of items 1 to 9, wherein said plant or part thereof comprises a recombinant nucleic acid encoding a PLATZ polypeptide.
11. Construct comprising:
    (i) nucleic acid encoding a PLATZ polypeptide as defined in items 1 or 2;
    (ii) one or more control sequences capable of driving expression of the nucleic acid sequence of (i); and optionally
    (iii) a transcription termination sequence.
12. Construct according to item 11, wherein one of said control sequences is a constitutive promoter, preferably a GOS2 promoter, most preferably a GOS2 promoter from rice.
13. Use of a construct according to item 11 or 12 in a method for making plants having increased yield, particularly increased biomass and/or increased seed yield relative to control plants.
14. Plant, plant part or plant cell transformed with a construct according to item 11 or 12.
15. Method for the production of a transgenic plant having increased yield, particularly increased biomass and/or increased seed yield relative to control plants, comprising:
    (i) introducing and expressing in a plant a nucleic acid encoding a PLATZ polypeptide as defined in item 1 or 2; and
    (ii) cultivating the plant cell under conditions promoting plant growth and development.
16. Transgenic plant having increased yield, particularly increased biomass and/or increased seed yield, relative to control plants, resulting from modulated expression of a nucleic acid encoding a PLATZ polypeptide as defined in item 1 or 2, or a transgenic plant cell derived from said transgenic plant.
17. Transgenic plant according to item 10, 14 or 16, or a transgenic plant cell derived thereof, wherein said plant is a crop plant or a monocot or a cereal, such as rice, maize, wheat, barley, millet, rye, triticale, sorghum emmer, spelt, secale, einkorn, teff, milo and oats.
18. Harvestable parts of a plant according to item 17, wherein said harvestable parts are preferably shoot biomass and/or seeds.
19. Products derived from a plant according to item 17 and/or from harvestable parts of a plant according to item 19.
20. Use of a nucleic acid encoding a PLATZ polypeptide in increasing yield, particularly in increasing seed yield and/or shoot biomass in plants, relative to control plants.
21. An isolated nucleic acid molecule selected from:
    (i) a nucleic acid represented by SEQ ID NO: 354;
    (ii) the complement of a nucleic acid represented by SEQ ID NO: 354;
    (iii) a nucleic acid encoding a PLATZ polypeptide having, in increasing order of preference, at least 50%, 55%, 60%, 65%, 70%, 75%, 80%, 85%, 90%, 95%, 96%, 97%, 98%, 99% or more sequence identity to the amino acid sequence represented by SEQ ID NO: 355, and having in increasing order of preference at least 50%, 55%, 60%, 65%, 70%, 75%, 80%, 85%, 90%, 95%, 96%, 97%, 98%, 99% or more sequence identity to one or more of the motifs as defined hereabove.
22. An isolated polypeptide selected from:
    (i) an amino acid sequence represented by SEQ ID NO: 355;
    (ii) an amino acid sequence having, in increasing order of preference, at least 50%, 55%, 60%, 65%, 70%, 75%, 80%, 85%, 90%, 95%, 96%, 97%, 98%, 99% or more sequence identity to the amino acid sequence represented by SEQ ID NO: 355, and having in increasing order of preference at least 50%, 55%, 60%, 65%, 70%, 75%, 80%, 85%, 90%, 95%, 96%, 97%, 98%, 99% or more sequence identity to one or more of the motifs as defined hereabove;

(iii) derivatives of any of the amino acid sequences given in (i) or (ii) above.

5. PLST-Like Polypeptides

In another aspect, the invention is characterised by one or more of the following items:

1. A method for enhancing yield-related traits in plants relative to control plants, comprising modulating expression in a plant of a nucleic acid encoding a PLST-like polypeptide, wherein said polypeptide comprising at least a PLST consensus domain with a PFam accession number PF02298.
2. Method according to item 1, wherein the PLST domain of the PLST-like polypeptide has at least, in increasing order of preference, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the sequence located between amino acid 38 and 124 of SEQ ID NO 411.
3. Method according to any of the items 1 or 2, wherein said PLST-like polypeptide may also comprise sequence motifs having at least, in increasing order of preference 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to anyone of the following motifs:

```
(i)
Motif 19:
                                        (SEQ ID NO: 530)
[DH]SV[LI]QV[TS]KE[DA][YF][DK]SCNT[SK][NSD]P (ii)
Motif 20:
                                        (SEQ ID NO: 531)
[FHY]YF[IT]SGV[PK][GD][HN]C (iii)
Motif 21:
                                        (SEQ ID NO: 532)
Y[NT][QK]WA[ESK][KS]NRF[KQ][IV]GD[ST][LI][VL]F

[KL]YP
```

4. Method, according to any of the items 1 to 3, wherein said PLST-like polypeptide may also comprise any one or more sequence motifs having at least, in increasing order of preference 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to anyone of the following motifs:

```
(i)
Motif 22:
                                        (SEQ ID NO: 533)
[DN]GN[TS][LVK][FV][KN][LF][DT]R[SP]GP[FY]YF[IT]

SG[VA][KP][GD][HN]CEK[GN][QE]K (ii)
Motif 23:
                                        (SEQ ID NO: 534)
[YL]N[QK]WA[EK][KS][NH]RF[KQ][IV]GD[ST]L[LV]F[LK]

Y[PD]

(iii)
Motif 24:
                                        (SEQ ID NO: 535)
[KQ]DSV[LI]QVTKE[DA]YKSCNT[SK][DSN]PI
```

5. Method, according to any of the items 1 to 4, wherein said PLST-like polypeptide may also comprise any one or more of the following sequence motifs having at least, in increasing order of preference 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to anyone of the following motifs:

```
(i)
Motif 25:
                                        (SEQ ID NO: 536)
DSVI[QV]VT[EKA][EQ]S[YF][KN][SK]CNL[KST]DPIL[YF]

[MS]N[ND]GN[ST][LV]FN[LI][TD][RS]PGL[FY]YF[TI]SG

[VA][PS]GHC[EQ][KR]

(ii)
Motif 26:
                                        (SEQ ID NO: 537)
P[PT]SA[DN]P[DQ][VL]YTKW[AS][KS][NS][HN][RN]FK

[IL]GD[ST][LI]LFLYP (iii)
Motif 27:
                                        (SEQ ID NO: 538)
XVS[CS]Y[QE][YF]KVG[DG]LD[AGS]W.
```

6. Method, according to any of the items 1 to 5, wherein said PLST-like polypeptide may also comprise any one or more of the following sequence motifs having at least, in increasing order of preference 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to anyone of the following motifs:

```
(i)
Motif 28:
                                        (SEQ ID NO: 539)
HN[FL]K[IL]GDSLLFLYPPSQDSVIQVTA[QE][SAN][YF][KN]

SC[ND]L[KS]DPILYMN[DN]GNSLFN[IL]T (ii)
Motif 29:
                                        (SEQ ID NO: 540)
GDFYFTSG[AVE]PGHC[EQ]K[SK]QKLH[IV]

(iii)
Motif 30:
                                        (SEQ ID NO: 541)
VSCYQYKVGDLD[AS]WGIPTSA[NK].
```

7. Method, according to any of the items 1 to 6, wherein the homologue of PLST-like polypeptide has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by any of the polypeptides of Table A5, preferably by the SEQ ID NO: 411.

8. Method, according to any of the items 1 to 7, wherein said modulated expression is effected by introducing and expressing in a plant a nucleic acid encoding a PLST-like polypeptide as defined in any of the previous items.

9. Method according to any one of items 1 to 8, wherein said nucleic acid encoding a PLST-like polypeptide encodes any one of the proteins listed in Table A5 or is a portion of such a nucleic acid, or a nucleic acid capable of hybridising with such a nucleic acid.

10. Method according to any one of items 1 to 9, wherein said nucleic acid sequence encodes an orthologue or paralogue of any of the proteins given in Table A5.

11. Method according to any preceding item, wherein said enhanced yield-related traits comprise increased yield, preferably increased seed yield relative to control plants.

12. Method according to any one of items 1 to 11, wherein said enhanced yield-related traits are obtained under non-stress conditions.

13. Method according to any one of items 1 to 11, wherein said enhanced yield-related traits are obtained under conditions of drought stress, salt stress or nitrogen deficiency.

14. Method according to any one of items 8 to 10, wherein said nucleic acid is operably linked to a constitutive promoter, preferably to a GOS2 promoter, most preferably to a GOS2 promoter from rice.

15. Method according to any one of items 1 to 14, wherein said nucleic acid encoding a PLST-like polypeptide is of plant origin.

16. Method according to item 15 wherein said nucleic acid encoding a PLST-like polypeptide is from a dicotyledonous plant, further preferably from the family Salicaceae, most preferably the nucleic acid is from Populus trichocarpa.

17. Plant or part thereof, including seeds, obtainable by a method according to any one of items 1 to 16, wherein said plant or part thereof comprises a recombinant nucleic acid encoding a PLST-like polypeptide.

18. Construct comprising:
 (i) nucleic acid encoding a PLST-like polypeptide as defined in items 1 to 7;
 (ii) one or more control sequences capable of driving expression of the nucleic acid sequence of (a); and optionally
 (iii) a transcription termination sequence.

19. Construct according to item 18, wherein one of said control sequences is a constitutive promoter, preferably a GOS2 promoter, most preferably a GOS2 promoter from rice.

20. Use of a construct according to items 18 or 19 in a method for making plants having increased yield, particularly increased seed yield relative to control plants.

21. Plant, plant part or plant cell transformed with a construct according to items 18 or 19.

22. Method for the production of a transgenic plant having increased yield, particularly increased biomass and/or increased seed yield relative to control plants, comprising:
 (i) introducing and expressing in a plant a nucleic acid encoding a PLST-like polypeptide as defined in items 1 to 7; and
 (ii) cultivating the plant cell under conditions promoting plant growth and development.

23. Transgenic plant having increased yield, particularly increased biomass and/or increased seed yield, relative to control plants, resulting from modulated expression of a nucleic acid encoding a PLST-like polypeptide as defined in items 1 to 7, or a transgenic plant cell derived from said transgenic plant.

24. Transgenic plant according to item 17, 21 or 23, or a transgenic plant cell derived thereof, wherein said plant is a crop plant or a monocot or a cereal, such as rice, maize, wheat, barley, millet, rye, triticale, sorghum emmer, spelt, secale, einkorn, teff, milo and oats.

25. Harvestable parts of a plant according to item 24, wherein said harvestable parts are preferably seeds.

26. Products derived from a plant according to item 24 and/or from harvestable parts of a plant according to item 25.

27. Use of a nucleic acid encoding a PLST-like polypeptide in enhancing yield characteristics, particularly in increasing seed yield in plants, relative to control plants.

28. An isolated nucleic acid molecule selected from:
 (i) a nucleic acid represented by SEQ ID NO: 414; SEQ ID NO: 426; SEQ ID NO: 428; SEQ ID NO: 434; SEQ ID NO: 438;
 (ii) the complement of a nucleic acid represented by SEQ ID NO: 414; SEQ ID NO: 426; SEQ ID NO: 428; SEQ ID NO: 434; SEQ ID NO: 438;
 (iii) a nucleic acid encoding a PLST-like polypeptide as represented by any one of SEQ ID NO: 415; SEQ ID NO: 427; SEQ ID NO: 429; SEQ ID NO: 435; SEQ ID NO: 439, preferably as a result of the degeneracy of the genetic code, said isolated nucleic acid can be derived from a polypeptide sequence as represented by any one of said SEQ IDs and further preferably confers enhanced yield related traits relative to control plants;
 (iv) a nucleic acid having, in increasing order of preference, at least 50%, 55%, 60%, 65%, 70%, 75%, 80%, 85%, 90%, 95%, 96%, 97%, 98%, 99% or more sequence identity with any of the nucleic acid sequences of Table A5 and further preferably confers enhanced yield related traits relative to control plants;
 (v) a nucleic acid molecule which hybridizes with a nucleic acid molecule of (i) to (iv) under stringent hybridization conditions and preferably confers enhanced yield related traits relative to control plants;
 (vi) a nucleic acid encoding a PLST-like polypeptide having in increasing order of preference at least 50%, 55%, 60%, 65%, 70%, 75%, 80%, 85%, 90%, 95%, 96%, 97%, 98%, 99% or more sequence identity to any one of SEQ ID NO: 415; SEQ ID NO: 427; SEQ ID NO: 429; SEQ ID NO: 435; SEQ ID NO: 439 and any of the other amino acid sequences in Table A5 and preferably confers enhanced yield related traits relative to control plants.

29. According to a further embodiment of the present invention, there is also provided an isolated polypeptide selected from:
 (i) an amino acid sequence represented by SEQ ID NO: 415; SEQ ID NO: 427; SEQ ID NO: 429; SEQ ID NO: 435; SEQ ID NO: 439;
 (ii) an amino acid sequence having, in increasing order of preference, at least 50%, 55%, 60%, 65%, 70%, 75%, 80%, 85%, 90%, 95%, 96%, 97%, 98%, 99% or more sequence identity to the amino acid sequence represented by SEQ ID NO: Y, and having in increasing order of preference at least 50%, 55%, 60%, 65%, 70%, 75%, 80%, 85%, 90%, 95%, 96%, 97%, 98%, 99% or more sequence identity to SEQ ID NO: 415; SEQ ID NO: 427; SEQ ID NO: 429; SEQ ID NO: 435; SEQ ID NO: 439;
(iii) derivatives of any of the amino acid sequences given in (i) or (ii) above.

6. Glomalin Polypeptides

In another aspect, the invention is characterised by one or more of the following items:

1. A method for enhancing yield-related traits in plants relative to control plants, comprising modulating expression in a plant of a nucleic acid encoding a Glomalin polypeptide, wherein said Glomalin polypeptide comprises a Cpn60_TCP1 domain.
2. Method according to item 1, wherein said Glomalin polypeptide comprises one or more of the motifs 31 to 43 (SEQ ID NO: 596 to SEQ ID NO: 608).
3. Method according to item 1 or 2, wherein said modulated expression is effected by introducing and expressing in a plant a nucleic acid encoding a Glomalin polypeptide.
4. Method according to any one of items 1 to 3, wherein said nucleic acid encoding a Glomalin polypeptide encodes any one of the proteins listed in Table A6 or is a portion of such a nucleic acid, or a nucleic acid capable of hybridising with such a nucleic acid.
5. Method according to any one of items 1 to 4, wherein said nucleic acid sequence encodes an orthologue or paralogue of any of the proteins given in Table A6.
6. Method according to any preceding item, wherein said enhanced yield-related traits comprise increased yield, preferably increased seed yield relative to control plants.
7. Method according to any one of items 1 to 6, wherein said enhanced yield-related traits are obtained under non-stress conditions.
8. Method according to any one of items 3 to 7, wherein said nucleic acid is operably linked to a root specific promoter, preferably to an RCc3 promoter, most preferably to an RCc3 promoter from rice.
9. Method according to any one of items 1 to 8, wherein said nucleic acid encoding a Glomalin polypeptide is of plant origin, preferably from a dicotyledonous plant, further preferably from the family Poaceae, more preferably from the genus *Oryza*, most preferably from *Oryza sativa*.
10. Plant or part thereof, including seeds, obtainable by a method according to any one of items 1 to 9, wherein said plant or part thereof comprises a recombinant nucleic acid encoding a Glomalin polypeptide.
11. Construct comprising:
    (i) nucleic acid encoding a Glomalin polypeptide as defined in items 1 or 2;
    (ii) one or more control sequences capable of driving expression of the nucleic acid sequence of (a); and optionally
    (iii) a transcription termination sequence.
12. Construct according to item 11, wherein one of said control sequences is a constitutive promoter, preferably an RCc3 promoter, most preferably an RCc3 promoter from rice.
13. Use of a construct according to item 11 or 12 in a method for making plants having increased yield, particularly increased seed yield relative to control plants.
14. Plant, plant part or plant cell transformed with a construct according to item 11 or 12.
15. Method for the production of a transgenic plant having increased yield, particularly increased seed yield relative to control plants, comprising:
    (i) introducing and expressing in a plant a nucleic acid encoding a Glomalin polypeptide as defined in item 1 or 2; and
    (ii) cultivating the plant cell under conditions promoting plant growth and development.
16. Transgenic plant having increased yield, particularly increased seed yield, relative to control plants, resulting from modulated expression of a nucleic acid encoding a Glomalin polypeptide as defined in item 1 or 2, or a transgenic plant cell derived from said transgenic plant.
17. Transgenic plant according to item 10, 14 or 16, or a transgenic plant cell derived thereof, wherein said plant is a crop plant or a monocot or a cereal, such as rice, maize, wheat, barley, millet, rye, triticale, sorghum emmer, spelt, secale, einkorn, teff, milo and oats.
18. Harvestable parts of a plant according to item 17, wherein said harvestable parts are preferably seeds.
19. Products derived from a plant according to item 18 and/or from harvestable parts of a plant according to item 18.
20. Use of a nucleic acid encoding a Glomalin polypeptide in increasing yield, particularly in increasing seed yield in plants, relative to control plants.

DESCRIPTION OF FIGURES

The present invention will now be described with reference to the following figures in which:

FIG. 3 represents a multiple alignment of SCAMP polypeptides. Sequences shown are: H.vulgare_TA39331_4513#1 (SEQ ID NO: 109); T.aestivum_TA81857_4565#1 (SEQ ID NO:177); Z.mays_ZM07MC31327_BFb0342A21@(SEQ ID NO: 181); Z.mays_ZM07MC32029_BFb0293C15@ (SEQ ID NO: 189); O.sativa_LOC_Os07g37740.1#1(SEQ ID NO: 137); O.sativa_LOC_Os05g42330.1#1(SEQ ID NO: 139); Z.mays_ZM07MC22858_BFb0220H23@ (SEQ ID NO: 183); H.vulgare_TA36210_4513#1(SEQ ID NO: 115); O.sativa_LOC Os01g57220.1#1(SEQ ID NO: 123); Z.mays_ZM07MC27067_BFb0182018@ (SEQ ID NO: 191); T.aestivum_TA51636_4565#(SEQ ID NO: 169); T.aestivum_CK163668#(SEQ ID NO: 179); T.aestivum_TA50955_4565#1(SEQ ID NO: 175); T.aestivum_TA72069_4565#1(SEQ ID NO: 167); A.thaliana_AT2G20840.1#1(SEQ ID NO: 97); B.napus_BN06MC09315_42883615@9SEQ ID NO: 103); P.trichocarpa_scaff_120.48#1(SEQ ID NO: 151);

P.trichocarpa_scaff_XIII.1138# (SEQ ID NO: 153); A.thaliana_AT1G03550.1#1(SEQ ID NO: 89); S.lycopersicum_TA43976_4081#1(SEQ ID NO: 159); A.thaliana_AT1G61250.1#1(SEQ ID NO: 91); B.napus_BN06MC05708_42365297@5(SEQ ID NO: 101); A.thaliana_AT1G11180.1#1(SEQ ID NO: 99); M.truncatula_TA20357_3880#1(SEQ ID NO: 119); P.sativum_TA772_3888#1(SEQ ID NO: 147); G.max_GM06MC34782_sp08b05@3397(SEQ ID NO: 107); M.truncatula_TA21989_3880#1(SEQ ID NO: 117); P.trichocarpa_scaff_XI.291#1(SEQ ID NO: 149); S.lycopersicum_TA41016_4081#1(SEQ ID NO: 161); O.sativa_LOC_Os03g38590.2#1(SEQ ID NO: 125); O.sativa_LOC_Os03g38590.1#1(SEQ ID NO: 127); H.vulgare_TA44339_4513#1(SEQ ID NO: 113); Z.mays_ZM07MC25122_BFb0162CO2@ (SEQ ID NO: 185); Z.mays_ZM07MC20385_BFb0172E11@ (SEQ ID NO: 193); O.sativa_LOC_Os03g38600.1#1(SEQ ID NO: 131); P.patens_147248#1(SEQ ID NO: 141); P.patens_181545#1(SEQ ID NO: 143); P.patens_178454#1(SEQ ID NO: 145); A.cepa_TA5060_4679#1(SEQ ID NO: 95); M.truncatula_TA32267_3880#1(SEQ ID NO: 121); A.thaliana_AT1G32050.1#1 (SEQ ID NO: 93); B.napus_BN06MC16749_45336122@,1 (SEQ ID NO: 105); P.trichocarpa_scaff_III.723#1 (SEQ ID NO: 155); P.trichocarpa_scaff_29.268#1 (SEQ ID NO: 157); H.vulgare_TA38269_4513#1 (SEQ ID NO: 111); T.aestivum_TA75461_4565#1(SEQ ID NO: 173); T.aestivum_TA75459_4565#1 (SEQ ID NO: 165); Z.mays_ZM07MC20685_BFb0020D20@ (SEQ ID NO: 187); O.sativa_LOC_Os04g50890.1#1(SEQ ID NO: 127); O.sativa_LOC_Os02g47010.1#1(SEQ ID NO: 135); T.aestivum_DR738056#1(SEQ ID NO: 171); O.sativa_LOC_Os08g06440.1#1(SEQ ID NO: 133); and T.aestivum_TA95653_4565#1(SEQ ID NO: 163).

Figure 4:
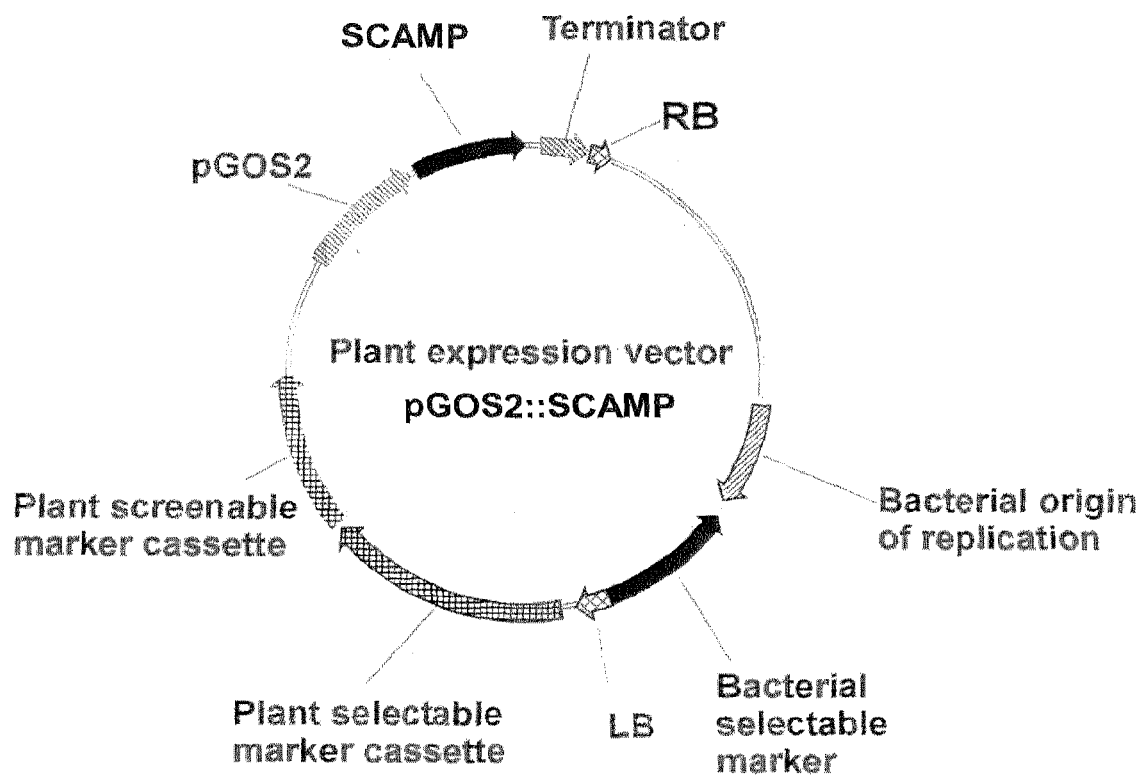

FIG. 4 represents the binary vector used for increased expression in Oryza sativa of a SCAMP-like-encoding nucleic acid under the control of a rice GOS2promoter (pGOS2).

FIG. 5 shows a multiple alignment of fibrillin polypeptide sequences which was performed using the AlignX (from Vector NTI 10.3, Invitrogen Corporation) multiple sequence alignment. The conserved PAP fibrillin PF04755 is marked by X under the consensus sequence. The conserved C-terminal domain is also marked by X under the consensus sequence. Sequences shown are: L.esculentum QC (SEQ ID NO: 205); AT2G46910.1 (SEQ ID NO: 225); B.napus_BN06MC20042 (SEQ ID NO: 207); P.patens_202760 (SEQ ID NO: 237); P.sitchensis_TA_14105 3332(SEQ ID NO: 239); O.sativa_AK241632 (SEQ ID NO: 233); S.bicolor_Sb01g017450.1 (SEQ ID NO: 243); Z.mays_TC447544 (SEQ ID NO: 251); C.solstitialis_TA2061_347529 (SEQ ID NO: 211); L.virosa_DW148855 (SEQ ID NO: 227);

G,hirsutum_TC97719 (SEQ ID NO: 217); G.raimondii_TC7628(SEQ ID NO: 223); P.trichocarpa_552393 (SEQ ID NO: 241); M.domestica_TC4908(SEQ ID NO: 229); V.vinifera_GSVIVT00026214001 (SEQ ID NO: 249); G.max_Glyma07g00410.1 (SEQ ID NO: 219); G.max_GM06MC19234 (SEQ ID NO: 221); N.tabacum_TC21276 (SEQ ID NO: 231); T.pratense_TA1297_57577 (SEQ ID NO: 247); C.reinhardtii_190008 (SEQ ID NO: 209); O.taurii _36262 (SEQ ID NO: 235); S.moellendorffii_422148 (SEQ ID NO: 245); Chlorella_141300 (SEQ ID NO: 215); and C.vulgaris_102074 (SEQ ID NO: 213).

Figure 6:
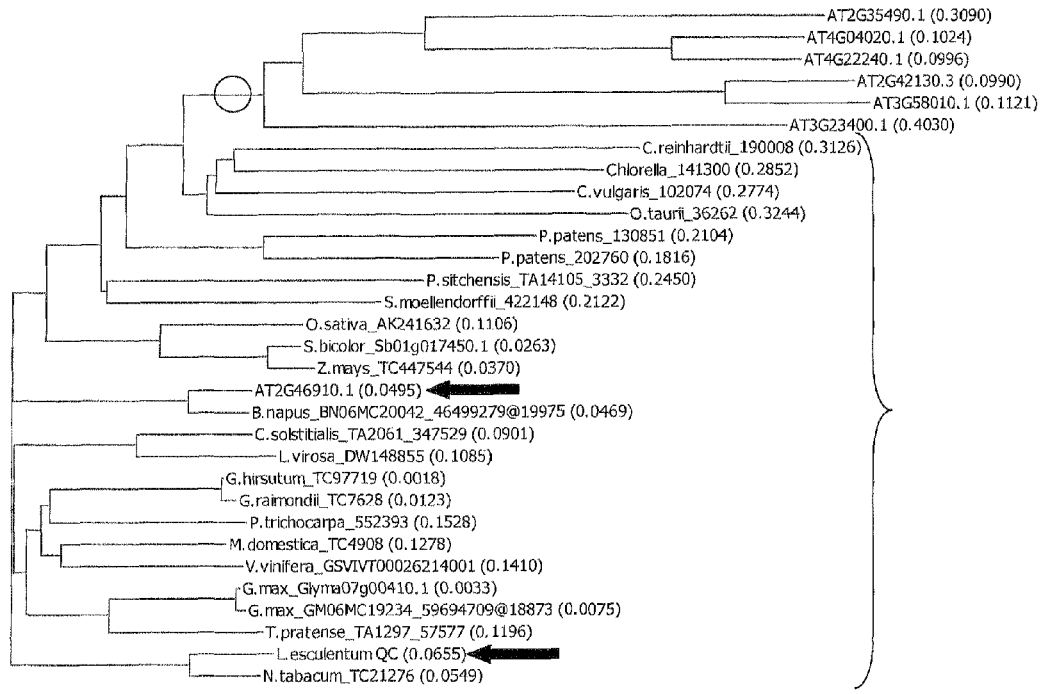

FIG. 6 shows a phylogenetic tree of fibrillin polypeptides constructed using a neighbour-joining clustering algorithm as provided in the AlignX programme from the Vector NTI (Invitrogen).

Figure 7:
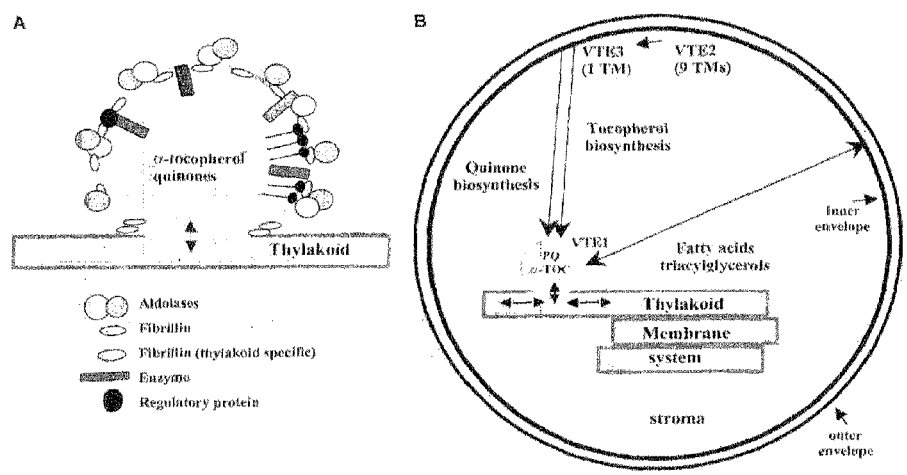

FIG. 7 taken from Ytterberg et al., 2006 (Plant Physiology, March 2006, Vol. 140, pp. 984-997) shows a schematic overview of proposed organization (A) and functional role of the plastoglobule (PG) and its proteome (B). PGs consist of a monolayer of lipids and sequester different hydrophilic small molecules, such as quinones and tocopherols. Structural proteins (fibrillins) and enzymes are attached to or embedded in the monolayer, but proteins lack transmembrane domains (A). Integration of PG functions in plastid metabolism (B).

FIG. 8 represents sequence logos for the three Conserved domain X, Y and Z as determined by MEME algorithm. Sequence logos are a graphical representation of an amino acid multiple sequence alignment, consisting of stacks of symbols, one stack for each position in the sequence. The overall height of the stack indicates the sequence conservation at that position, while the height of symbols within the stack indicates the relative frequency of each amino or nucleic acid at that position.

Figure 9:
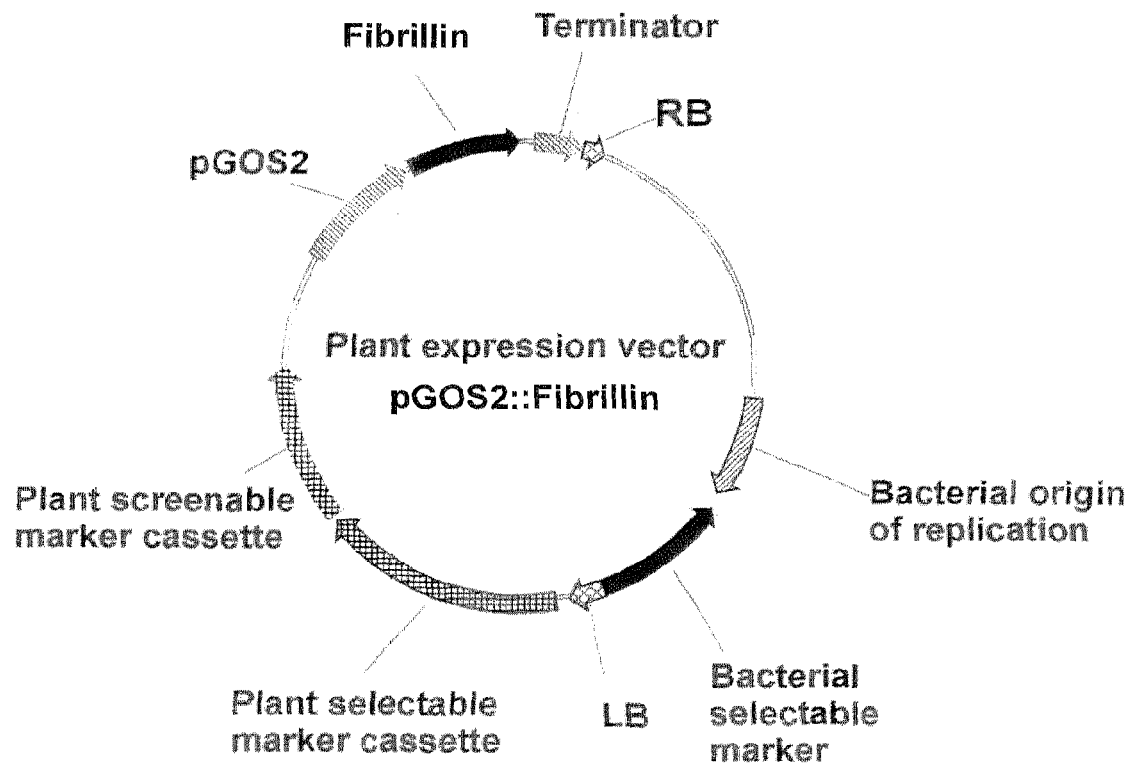

FIG. 9 represents the binary vector used for increased expression in Oryza sativaof a fibrillin-encoding nucleic acid under the control of a rice GOS2 promoter (pGOS2).

FIG. 10 represents the domain structure of SEQ ID NO: 261 with indication of the conserved motifs 10 to 18, and the PLATZ domain (bold italics).

Figure 11:
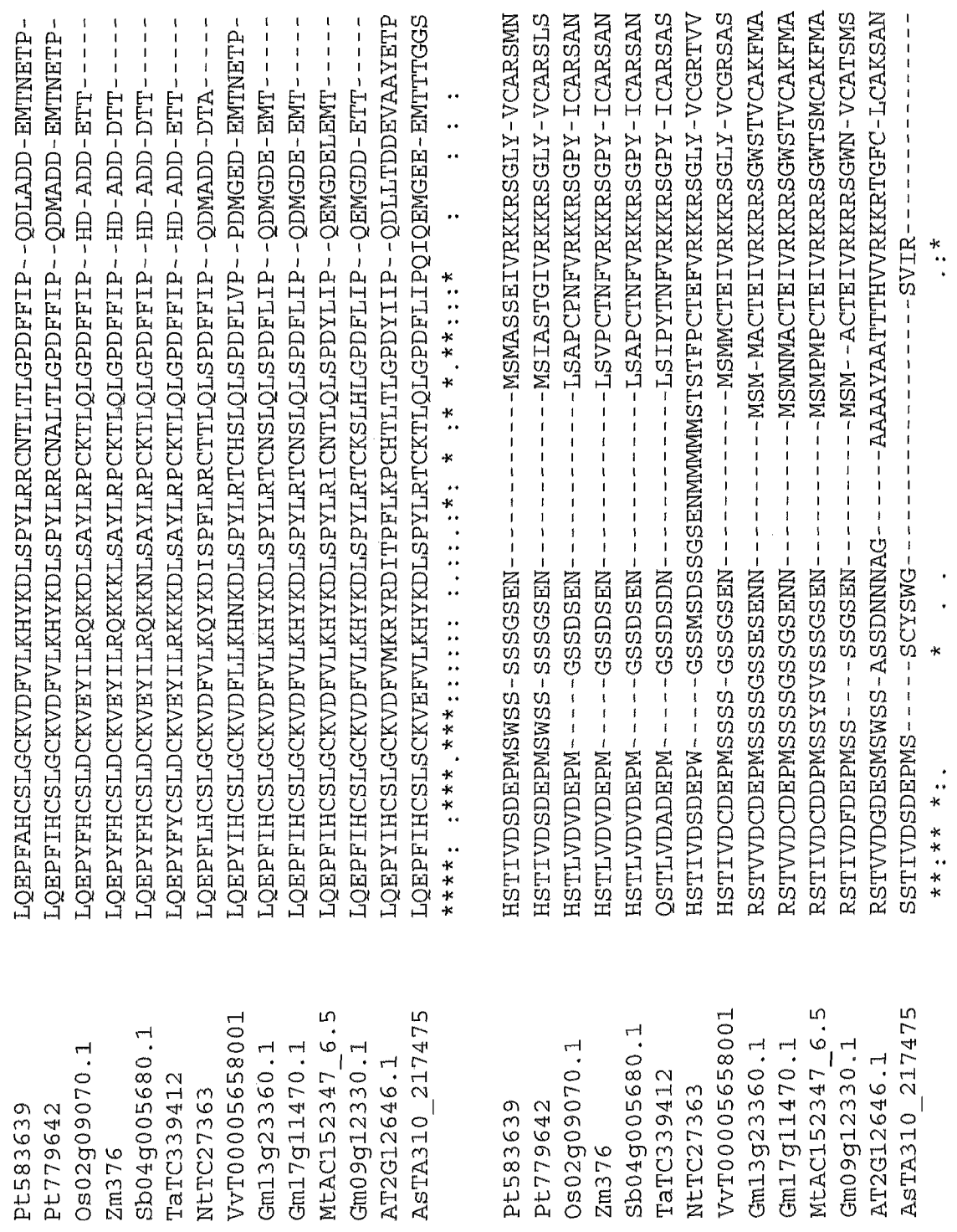

FIG. 11 represents a multiple alignment of various PLATZ-A1-αpolypeptides using ClustalW with default settings for a slow alignment. Sequences shown are: Pt583639 (SEQ ID NO: 261); Pt779642 (SEQ ID NO: 347); Os02g09070.1 (SEQ ID NO: 345); Zm376 (SEQ ID NO: 355); Sb04g005680.1 (SEQ ID NO: 349); TaTC339412 (SEQ ID NO: 351); NtTC27363(SEQ ID NO: 343); VvT00005658001 (SEQ ID NO: 353); Gm13g23360.1 (SEQ ID NO: 337); Gm17g11470.1 (SEQ ID NO: 339); MtAC152347_6.5 (SEQ ID NO: 341); Gm09g12330.1 (SEQ ID NO: 335); AT2G12646.1 (SEQ ID NO: 333); and AsTA310_217475 (SEQ ID NO: 331).

Figure 12:
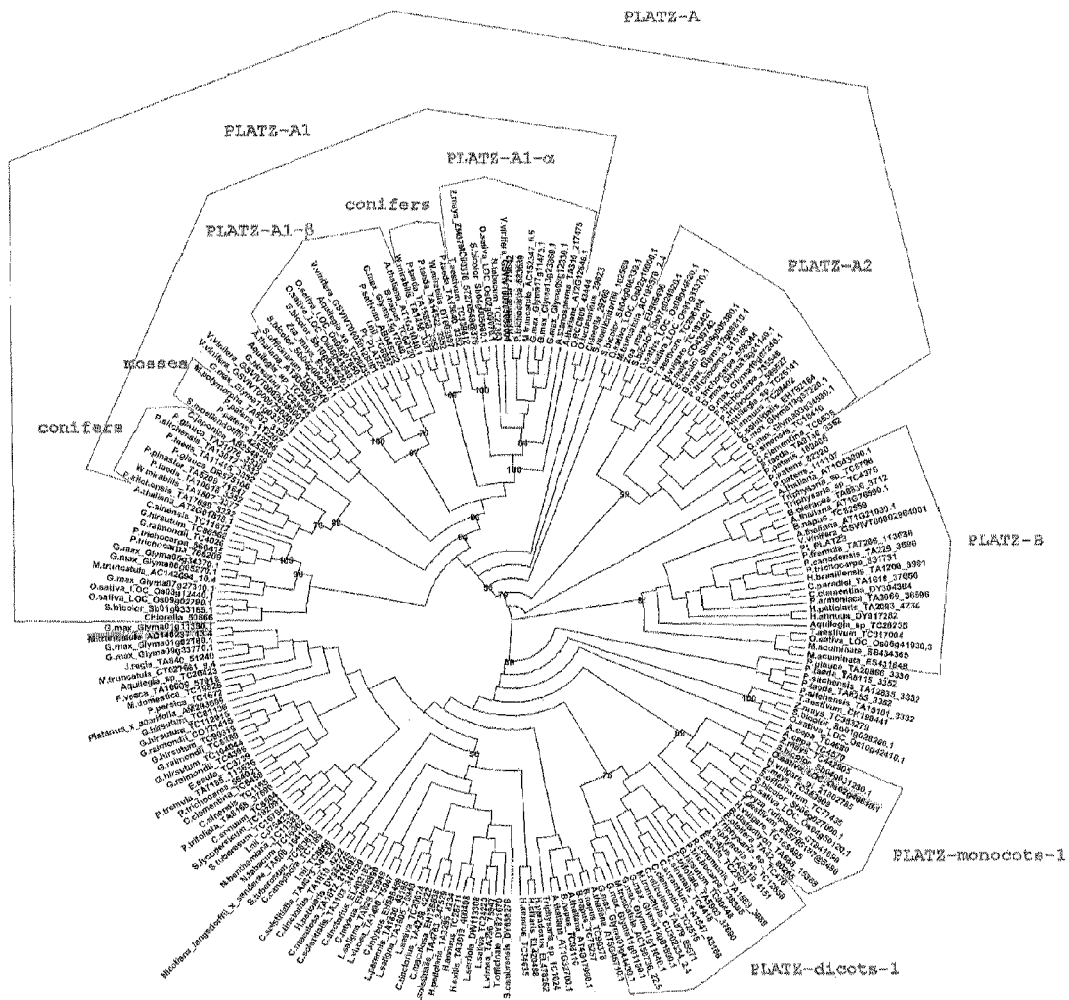

FIG. 12 shows phylogenetic tree of PLATZ polypeptides, the alignment was generated using MAFFT (Katoh and Toh (2008) Briefings in Bioinformatics 9:286-298). A neighbour-joining tree was calculated using QuickTree (Howe et al. (2002), Bioinformatics 18(11): 1546-7), 100 bootstrap repetitions. The circular phylogram was drawn using Dendroscope (Huson et al. (2007), BMC Bioinformatics 8(1):460). Confidence for 100bootstrap repetitions is indicated for major branching. Major branching position is indicated by circles. SEQ ID NO: 261 is represented as P.trichocarpa_583639, in the clade PLATZ-A1-α.

Figure 13:
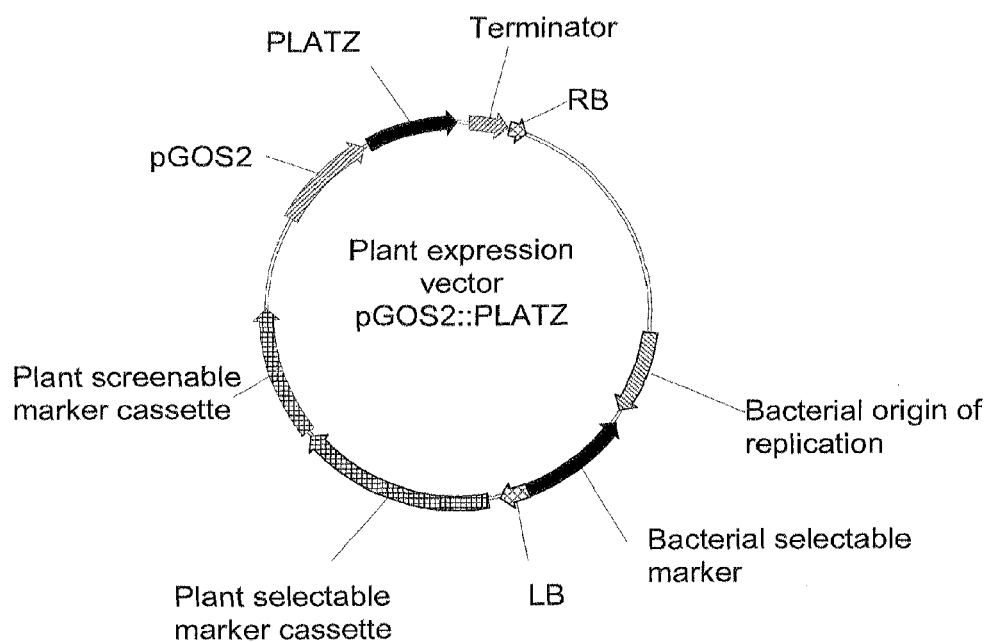

FIG. 13 represents the binary vector used for increased expression in Oryza sativa of a PLATZ-encoding nucleic acid under the control of a rice GOS2 promoter (pGOS2)

FIG. 14 represents SEQ ID NO 411 with indication of PF 02298 domain and motifs 19 to 30.

Figure 15:
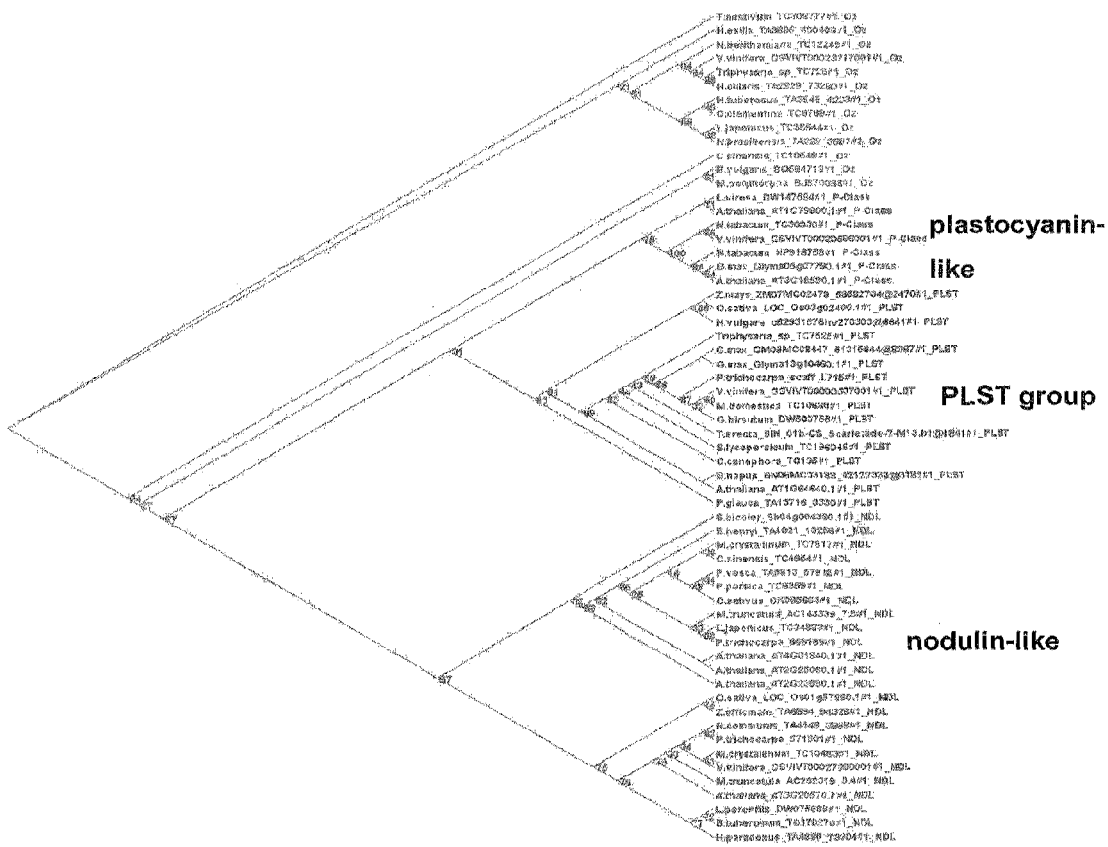

FIG. 15 represents the Phylogenetic tree of selected PLST-like proteins for the different clusters: P-class=plastocyanin-like, NDL=nodulin-like, Z=others, PLST =PLST group.

The alignment was generated using MAFFT (Katoh and Toh (2008) Briefings in Bioinformatics 9:286-298). A neighbour-joining tree was calculated using QuickTree (Howe et al. (2002), Bioinformatics 18(11): 1546-7), 100 bootstrap repetitions. The circular phylogram was drawn using Dendroscope (Huson et al. (2007), BMC Bioinformatics 8(1):

460). Confidence for 100 bootstrap repetitions is indicated for major branching. Major branching position is indicated by circles.

Figure 16:
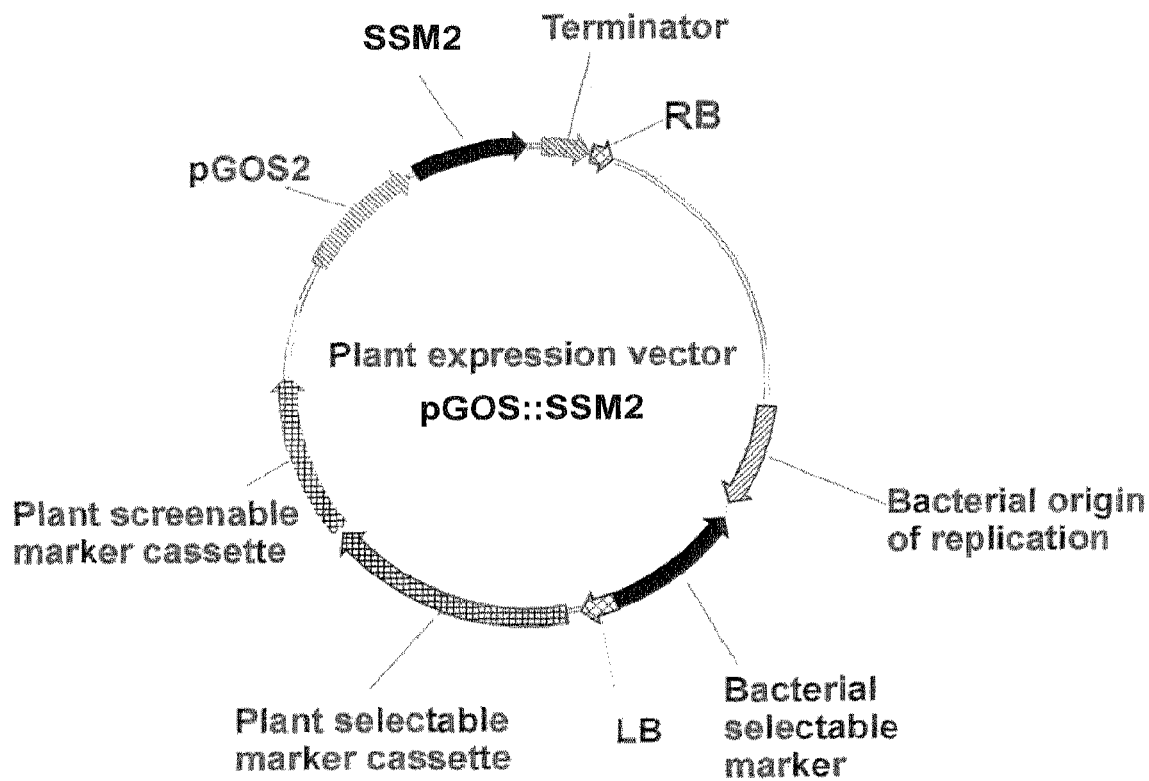

FIG. 16 represents the binary vector used for increased expression in *Oryza sativa* of a PLST-like-encoding nucleic acid under the control of a rice GOS2 promoter (pGOS2).

FIG. 17 represents the domain structure of SEQ ID NO: 546 with the conserved motifs 31 to 43 indicated and the Cpn60_TCP1 domain shown in bold.

FIG. 18 represents a multiple alignment of various Glomalin polypeptides. The asterisks indicate identical amino acids among the various protein sequences, colons represent highly conserved amino acid substitutions, and the dots represent less conserved amino acid substitution; on other positions there is no sequence conservation. These alignments can be used for defining further motifs, when using conserved amino acids. Sequences shown are: *P.patens*_226792 (SEQ ID NO: 580); *P.patens*_233067 (SEQ ID NO: 581); *P.patens*_163173(SEQ ID NO: 582); *P.patens*_56767 (SEQ ID NO: 583); *S.lycopersicum*_TC192865 (SEQ ID NO: 590); *L.esculentum*_gl_39 (SEQ ID NO: 591); *S.lycopersicum*_TC197855 (SEQ ID NO: 589); *A.thaliana*_AT3G23990 (SEQ ID NO: 574); *A.thaliana*_AT2G33210 (SEQ ID NO: 573); *O.sativa*_Os10g32550.1 (SEQ ID NO: 578); *O.sativa*_glomalin_SEQID2 (SEQ ID NO: 546); *O.sativa*_glomalin_39 (SEQ ID NO: 674); *O.sativa*_Os03g04970.1 (SEQ ID NO: 579); *Z.mays*_ZM07MC32795 (SEQ ID NO: 593); *T.aestivum*_c54647991 (SEQ ID NO: 592); *A.cepa*_CF435092 (SEQ ID NO: 571); *P.trichocarpa*_sc 1.447 (SEQ ID NO: 584); *P.trichocarpa*_sc_III.1436 (SEQ ID NO: 585);*M.truncatula*_AC161864_24 (SEQ ID NO: 575); *M.truncatula*_AC161864_3 (SEQ ID NO: 576); *A.thaliana*_AT3G13860.1 (SEQ ID NO: 572); *P.trichocarpa*_sc_44.102 (SEQ ID NO: 586); *S.lycopersicum*_TC204816 (SEQ ID NO: 588); *O.sativa*_Os05g46290 (SEQ ID NO: 577); and *Z.mays*_ZM07MC22894 (SEQ ID NO: 594).

Figure 19:
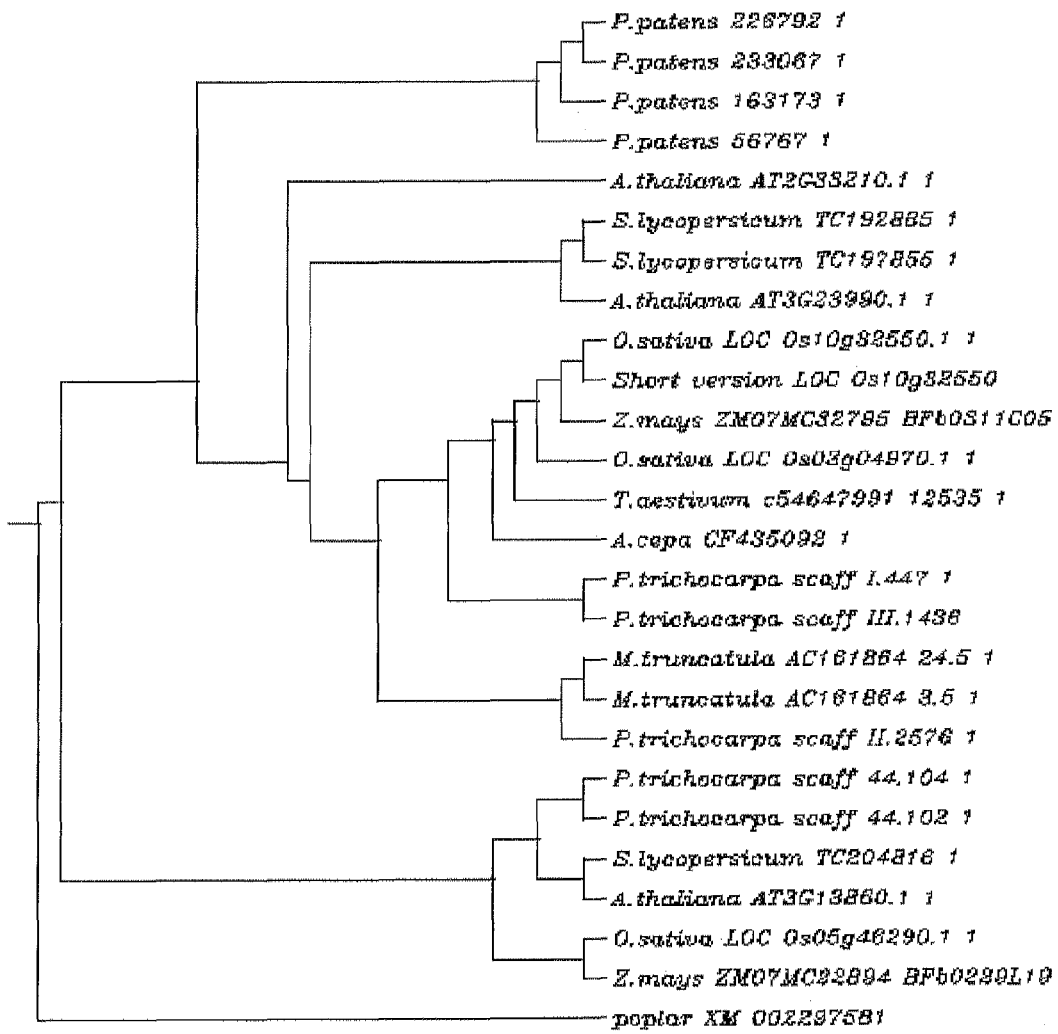

FIG. 19 shows phylogenetic tree of Glomalin polypeptides. The sequence XM_002297581 from poplar represents the outgroup. The other sequences represent the cluster of the Glomalin sequences.

Figure 20:
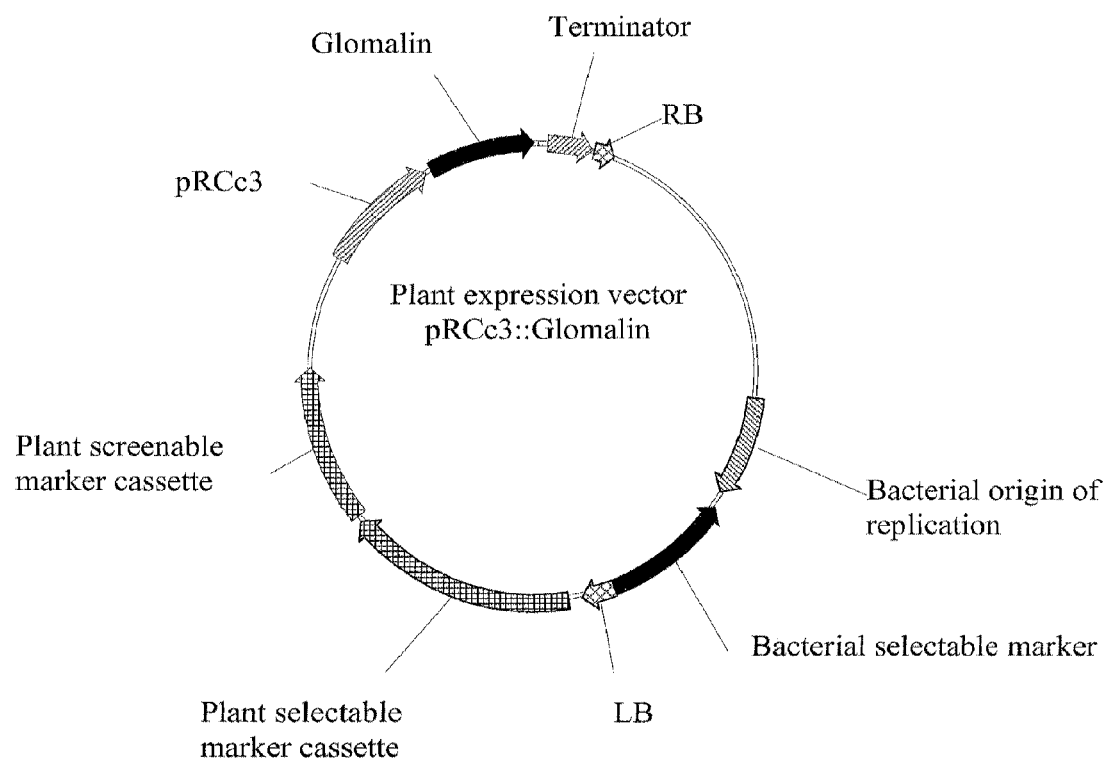

FIG. 20 represents the binary vector used for increased expression in *Oryza sativa* of a Glomalin-encoding nucleic acid under the control of a rice RCc3 promoter (pRC3)

EXAMPLES

The present invention will now be described with reference to the following examples, which are by way of illustration alone. The following examples are not intended to limit the scope of the invention.

DNA manipulation: unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

Example 1

Identification of Sequences Related to the Nucleic Acid Sequence Used in the Methods of the Invention Sequences (full length cDNA, ESTs or genomic) related to the eRF1 sequences were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program is used to find regions of local similarity between sequences by comparing nucleic acid or polypeptide sequences to sequence databases and by calculating the statistical significance of matches. For example, the polypeptide encoded by the nucleic acid used in the present invention was used for the TBLASTN algorithm, with default settings and the filter to ignore low complexity sequences set off. The output of the analysis was viewed by pairwise comparison, and ranked according to the probability score (E-value), where the score reflect the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length. In some instances, the default parameters may be adjusted to modify the stringency of the search. For example the E-value may be increased to show less stringent matches. This way, short nearly exact matches may be identified.

1.1. eRF1 Polypeptides

Table A1 provides a list of nucleic acid and polypeptide sequences related to SEQ ID NO: 1 and SEQ ID NO: 2.

TABLE A1

Examples of eRF1 nucleic acids and polypeptides:

| Name | Nucleic acid SEQ ID NO: | Polypeptide SEQ ID NO: |
|---|---|---|
| A.thaliana_AT1G12920.1 | 1 | 2 |
| A.thaliana_AT3G26618.1 | 3 | 4 |
| A.thaliana_AT5G47880.1 | 5 | 6 |
| Aquilegia_sp_TC23338 | 7 | 8 |
| C.sinensis_TC9326 | 9 | 10 |
| C.solstitialis_TA682_347529 | 11 | 12 |
| G.max_Glyma09g29600.1 | 13 | 14 |
| G.max_GM06MC33657_sm55b10@32878 | 15 | 16 |
| H.vulgare_c64960768hv270303@2598 | 17 | 18 |
| M.truncatula_AC136505_1.4 | 19 | 20 |
| O.sativa_LOC_Os01g71270.1 | 21 | 22 |
| O.sativa_LOC_Os03g49580.1 | 23 | 24 |
| P.glauca_TA15071_3330 | 25 | 26 |
| P.patens_58108 | 27 | 28 |
| P.trichocarpa_708902 | 29 | 30 |
| P.trichocarpa_732023 | 31 | 32 |
| S.lycopersicum_TC19702 | 33 | 34 |
| S.tuberosum_TC166984 | 35 | 36 |
| V.vinifera_GSVIVT0001464200 | 37 | 38 |
| A.anophagefferens_32373 | 39 | 40 |
| D.discoideum_XP_636638.1 | 41 | 42 |
| P.falciparum_XP_001349629 | 43 | 44 |
| D.melanogaster_NP_649210 | 45 | 46 |
| H.sapiens_NP_004721.1 | 47 | 48 |
| A.fumigatus_XP_754064.1 | 49 | 50 |
| C.glabrata_XP_449070.1 | 51 | 52 |
| D.hansenii_XP_457910.1 | 53 | 54 |

TABLE A1-continued

Examples of eRF1 nucleic acids and polypeptides:

| Name | Nucleic acid SEQ ID NO: | Polypeptide SEQ ID NO: |
|---|---|---|
| K.lactis__XP__452701.1 | 55 | 56 |
| N.crassa__EAA28060.1 | 57 | 58 |
| S.cerevisiae__XP__009701.1 | 59 | 60 |
| Y.lipolyticaXP__504906.1 | 61 | 62 |
| C.reinhardtii__182764 | 63 | 64 |
| Chlorella__29482 | 65 | 66 |
| O.RCC809__23895 | 67 | 68 |
| L.braziliensis__XP__0015659401 | 69 | 70 |
| T.brucei__XP__8283141 | 71 | 72 |

In some instances, related sequences have tentatively been assembled and publicly disclosed by research institutions, such as The Institute for Genomic Research (TIGR; beginning with TA). The Eukaryotic Gene Orthologs (EGO) database may be used to identify such related sequences, either by keyword search or by using the BLAST algorithm with the nucleic acid sequence or polypeptide sequence of interest. On other instances, special nucleic acid sequence databases have been created for particular organisms, such as by the Joint Genome Institute. Further, access to proprietary databases, has allowed the identification of novel nucleic acid and polypeptide sequences.

1.2. SCAMP-Like Polypeptides

Table A2 provides a list of nucleic acid and polypeptide sequences related to SEQ ID NO: 88 and SEQ ID NO: 89.

TABLE A2

Examples of SCAMP-like nucleic acids and polypeptides:

| Name | Nucleic acid SEQ ID NO: | Polypeptide SEQ ID NO: |
|---|---|---|
| A.thaliana__AT1G03550.1 | 88 | 89 |
| A.thaliana__AT1G61250.1 | 90 | 91 |
| A.thaliana__AT1G32050.1 | 92 | 93 |
| A.cepa__TA5060__4679 | 94 | 95 |
| A.thaliana__AT2G20840.1 | 96 | 97 |
| A.thaliana__AT1G11180.1 | 98 | 99 |
| B.napus__BN06MC05708__42365297@5693 | 100 | 101 |
| B.napus__BN06MC09315__42883615@9289 | 102 | 103 |
| B.napus__BN06MC16749__45336122@16695 | 104 | 105 |
| G.max__GM06MC34782__sp08b05@33970 | 106 | 107 |
| H.vulgare__TA39331__4513 | 108 | 109 |
| H.vulgare__TA38269__4513 | 110 | 111 |
| H.vulgare__TA44339__4513 | 112 | 113 |
| H.vulgare__TA36210__4513 | 114 | 115 |
| M.truncatula__TA21989__3880 | 116 | 117 |
| M.truncatula__TA20357__3880 | 118 | 119 |
| M.truncatula__TA32267__3880 | 120 | 121 |
| O.sativa__LOC__Os01g57220.1 | 122 | 123 |
| O.sativa__LOC__Os03g38590.2 | 124 | 125 |
| O.sativa__LOC__Os04g50890.1 | 126 | 127 |
| O.sativa__LOC__Os03g38590.1 | 128 | 129 |
| O.sativa__LOC__Os03g38600.1 | 130 | 131 |
| O.sativa__LOC__Os08g06440.1 | 132 | 133 |
| O.sativa__LOC__Os02g47010.1 | 134 | 135 |
| O.sativa__LOC__Os07g37740.1 | 136 | 137 |
| O.sativa__LOC__Os05g42330.1 | 138 | 139 |
| P.patens__147248 | 140 | 141 |
| P.patens__181545 | 142 | 143 |
| P.patens__178454 | 144 | 145 |
| P.sativum__TA772__3888 | 146 | 147 |
| P.trichocarpa__scaff__XI.291 | 148 | 149 |
| P.trichocarpa__scaff__120.48 | 150 | 151 |
| P.trichocarpa__scaff__XIII.1138 | 152 | 153 |

TABLE A2-continued

Examples of SCAMP-like nucleic acids and polypeptides:

| Name | Nucleic acid SEQ ID NO: | Polypeptide SEQ ID NO: |
|---|---|---|
| P.trichocarpa__scaff__III.723 | 154 | 155 |
| P.trichocarpa__scaff__29.268 | 156 | 157 |
| S.lycopersicum__TA43976__4081 | 158 | 159 |
| S.lycopersicum__TA41016__4081 | 160 | 161 |
| T.aestivum__TA95653__4565 | 162 | 163 |
| T.aestivum__TA75459__4565 | 164 | 165 |
| T.aestivum__TA72069__4565 | 166 | 167 |
| T.aestivum__TA51636__4565 | 168 | 169 |
| T.aestivum__DR738056 | 170 | 171 |
| T.aestivum__TA75461__4565 | 172 | 173 |
| T.aestivum__TA50955__4565 | 174 | 175 |
| T.aestivum__TA81857__4565 | 176 | 177 |
| T.aestivum__CK163668 | 178 | 179 |
| Z.mays__ZM07MC31327__BFb0342A21@31234 | 180 | 181 |
| Z.mays__ZM07MC22858__BFb0220H23@22794 | 182 | 183 |
| Z.mays__ZM07MC25122__BFb0162C02@25049 | 184 | 185 |
| Z.mays__ZM07MC20685__BFb0020D20@20631 | 186 | 187 |
| Z.mays__ZM07MC32029__BFb0293C15@31934 | 188 | 189 |
| Z.mays__ZM07MC27067__BFb0182O18@26987 | 190 | 191 |
| Z.mays__ZM07MC20385__BFb0172E11@20333 | 192 | 193 |
| A.thaliana__AT__x | 663 | 664 |
| A.thaliana__AT__y | 665 | 666 |

In some instances, related sequences have tentatively been assembled and publicly disclosed by research institutions, such as The Institute for Genomic Research (TIGR; beginning with TA). The Eukaryotic Gene Orthologs (EGO) database may be used to identify such related sequences, either by keyword search or by using the BLAST algorithm with the nucleic acid sequence or polypeptide sequence of interest. On other instances, special nucleic acid sequence databases have been created for particular organisms, such as by the Joint Genome Institute. Further, access to proprietary databases, has allowed the identification of novel nucleic acid and polypeptide sequences.

1.3. Fibrillin Polypeptides

Table A3 provides a list of nucleic acid and polypeptide sequences related to SEQ ID NO: 204 and SEQ ID NO: 205.

TABLE A3

Examples of fibrillin nucleic acids and polypeptides:

| Name | Nucleic acid SEQ ID NO: | Polypeptide SEQ ID NO: |
|---|---|---|
| L.esculentum QC | 204 | 205 |
| B.napus__BN06MC20042__46499279@19975#1 | 206 | 207 |
| C.reinhardtii__190008#1 | 208 | 209 |
| C.solstitialis__TA2061__347529#1 | 210 | 211 |
| C.vulgaris__102074#1 | 212 | 213 |
| Chlorella__141300#1 | 214 | 215 |
| G.hirsutum__TC97719#1 | 216 | 217 |
| G.max__Glyma07g00410.1#1 | 218 | 219 |
| G.max__GM06MC19234__59694709@18873#1 | 220 | 221 |
| G.raimondii__TC7628#1 | 222 | 223 |
| A.thaliana__AT2G46910.1#1 | 224 | 225 |
| L.virosa__DW148855#1 | 226 | 227 |
| M.domestica__TC4908#1 | 228 | 229 |
| N.tabacum__TC21276#1 | 230 | 231 |
| O.sativa__AK241632.1 | 232 | 233 |
| O.taurii__36262#1 | 234 | 235 |
| P.patens__202760#1 | 236 | 237 |
| P.sitchensis__TA14105__3332#1 | 238 | 239 |
| P.trichocarpa__552393#1 | 240 | 241 |
| S.bicolor__Sb01g017450.1#1 | 242 | 243 |

TABLE A3-continued

Examples of fibrillin nucleic acids and polypeptides:

| Name | Nucleic acid SEQ ID NO: | Polypeptide SEQ ID NO: |
|---|---|---|
| S.moellendorffii_422148#1 | 244 | 245 |
| T.pratense_TA1297_57577#1 | 246 | 247 |
| V.vinifera_GSVIVT00026214001#1 | 248 | 249 |
| Z.mays_TC447544#1 | 250 | 251 |

Research institutions, such as The Institute for Genomic Research (TIGR; beginning with TA), The Eukaryotic Gene Orthologs (EGO) database and The Joint Genome Institute may be used to identify further fibrillin sequences, either by a keyword search or by using the BLAST algorithm with the nucleic acid sequence or polypeptide sequence of interest.

1.4. PLATZ Polypeptides

Table A4 provides a list of nucleic acid and polypeptide sequences related to SEQ ID NO: 260 and SEQ ID NO: 261.

TABLE A4

Examples of PLATZ nucleic acids and polypeptides:

| Name | Nucleic acid SEQ ID NO: | Polypeptide SEQ ID NO: |
|---|---|---|
| P.trichocarpa_583639 | 260 | 261 |
| A.thaliana_AT2G01818.1 | 276 | 277 |
| A.thaliana_AT3G60670.1 | 278 | 279 |
| Aquilegia_sp_TC23605 | 280 | 281 |
| C.sinensis_TC11672 | 282 | 283 |
| Chlorella_29200 | 284 | 285 |
| Chlorella_50866 | 286 | 287 |
| G.hirsutum_TC83646 | 288 | 289 |
| G.hirsutum_TC86562 | 290 | 291 |
| G.max_Glyma05g34370.1 | 292 | 293 |
| G.max_Glyma07g27310.1 | 294 | 295 |
| G.max_Glyma08g05270.1 | 296 | 297 |
| G.max_Glyma11g03370.1 | 298 | 299 |
| G.raimondii_TC4026 | 300 | 301 |
| M.truncatula_AC142094_10.4 | 302 | 303 |
| M.truncatula_AC195570_2.4 | 304 | 305 |
| O.lucimarinus_29623 | 306 | 307 |
| O.RCC809_43444 | 308 | 309 |
| O.sativa_LOC_Os02g10000.1 | 310 | 311 |
| O.sativa_LOC_Os03g12440.1 | 312 | 313 |
| O.sativa_LOC_Os09g02790.1 | 314 | 315 |
| P.trichocarpa_566415 | 316 | 317 |
| P.trichocarpa_766209 | 318 | 319 |
| S.bicolor_Sb01g033165.1 | 320 | 321 |
| S.bicolor_Sb04g006330.1 | 322 | 323 |
| S.moellendorffii_102589 | 324 | 325 |
| V.vinifera_GSVIVT00007302001 | 326 | 327 |
| V.vinifera_GSVIVT00026380001 | 328 | 329 |
| A.stenosperma_TA310_217475 | 330 | 331 |
| A.thaliana_AT2G12646.1 | 332 | 333 |

TABLE A4-continued

Examples of PLATZ nucleic acids and polypeptides:

| Name | Nucleic acid SEQ ID NO: | Polypeptide SEQ ID NO: |
|---|---|---|
| G.max_Glyma09g12330.1 | 334 | 335 |
| G.max_Glyma13g23360.1 | 336 | 337 |
| G.max_Glyma17g11470.1 | 338 | 339 |
| M.truncatula_AC152347_6.5 | 340 | 341 |
| N.tabacum_TC27363 | 342 | 343 |
| O.sativa_LOC_Os02g09070.1 | 344 | 345 |
| P.trichocarpa_779642 | 346 | 347 |
| S.bicolor_Sb04g005680.1 | 348 | 349 |
| T.aestivum_TC339412 | 350 | 351 |
| V.vinifera_GSVIVT00005658001 | 352 | 353 |
| Z.mays_376 | 354 | 355 |
| A.thaliana_AT1G31040.1 | 356 | 357 |
| Aquilegia_sp_TC28233 | 358 | 359 |
| B.napus_TC69120 | 360 | 361 |
| G.max_Glyma15g17040.1 | 362 | 363 |
| I.nil_TC8897 | 364 | 365 |
| O.sativa_LOC_Os02g07650.1 | 366 | 367 |
| O.sativa_LOC_Os06g45540.1 | 368 | 369 |
| P.sativum_AB045222 | 370 | 371 |
| Pt_PLATZ4 | 372 | 373 |
| S.bicolor_Sb04g004830.1 | 374 | 375 |
| S.bicolor_Sb10g026620.1 | 376 | 377 |
| S.officinarum_TC85346 | 378 | 379 |
| V.vinifera_GSVIVT00030128001 | 380 | 381 |
| Zea_mays_EU968977 | 382 | 383 |
| C.japonica_AB254819 | 384 | 385 |
| P.glauca_DR575106 | 386 | 387 |
| P.glauca_TA21076_3330 | 388 | 389 |
| P.pinaster_TA5209_71647 | 390 | 391 |
| P.sitchensis_TA13012_3332 | 392 | 393 |
| P.sitchensis_TA17699_3332 | 394 | 395 |
| P.taeda_TA10616_3352 | 396 | 397 |
| P.taeda_TA11415_3352 | 398 | 399 |
| W.mirabilis_TA1807_3377 | 400 | 401 |
| M.polymorpha_TA832_3197 | 402 | 403 |
| P.patens_112207 | 404 | 405 |
| P.patens_112256 | 406 | 407 |
| S.moellendorffii_425306 | 408 | 409 |

In some instances, related sequences have tentatively been assembled and publicly disclosed by research institutions, such as The Institute for Genomic Research (TIGR; beginning with TA). The Eukaryotic Gene Orthologs (EGO) database may be used to identify such related sequences, either by keyword search or by using the BLAST algorithm with the nucleic acid sequence or polypeptide sequence of interest. On other instances, special nucleic acid sequence databases have been created for particular organisms, such as by the Joint Genome Institute. Further, access to proprietary databases, has allowed the identification of novel nucleic acid and polypeptide sequences.

1.5. PLST-Like Polypeptides

Table A5 provides a list of nucleic acid and polypeptide sequences related to SEQ ID NO: 410 and SEQ ID NO: 411.

TABLE A5

Examples of PLST-like nucleic acids and polypeptides:

| Name | Nucleic acid SEQ ID NO: | Polypeptide SEQ ID NO: |
|---|---|---|
| P.trichocarpa_scaff_I.715#1_PLST | 410 | 411 |
| A.thaliana_AT1G64640.1#1_PLST | 412 | 413 |
| B.napus_BN06MC03188_42122333@3181#1_PLST | 414 | 415 |
| C.canephora_TC195#1_PLST | 416 | 417 |

TABLE A5-continued

Examples of PLST-like nucleic acids and polypeptides:

| Name | Nucleic acid SEQ ID NO: | Polypeptide SEQ ID NO: |
|---|---|---|
| G.hirsutum_DW500755#1_PLST | 418 | 419 |
| M.domestica_TC10680#1_PLST | 420 | 421 |
| V.vinifera_GSVIVT00000537001#1_PLST | 422 | 423 |
| G.max_Glyma13g10460.1#1_PLST | 424 | 425 |
| G.max_GM06MC08447_51315644@8367#1_PLST | 426 | 427 |
| T.erecta_SIN_01b-CS_Scarletade-7-M13.b1@1841#1_PLST | 428 | 429 |
| S.lycopersicum_TC196046#1_PLST | 430 | 431 |
| Triphysaria_sp_TC7525#1_PLST | 432 | 433 |
| H.vulgare_c62931576hv270303@6641#1_PLST | 434 | 435 |
| O.sativa_LOC_Os03g02400.1#1_PLST | 436 | 437 |
| Z.mays_ZM07MC02479_58582734@2470#1_PLST | 438 | 439 |
| P.glauca_TA13716_3330#1_PLST | 440 | 441 |
| A.thaliana_AT3G18590.1#1_P-class | 442 | 443 |
| N.tabacum_NP916758#1_P-class | 444 | 445 |
| G.max_Glyma05g07790.1#1_P-class | 446 | 447 |
| N.tabacum_TC30930#1_P-class | 448 | 449 |
| V.vinifera_GSVIVT00020596001#1_P-class | 450 | 451 |
| A.thaliana_AT1G79800.1#1_P-class | 452 | 453 |
| L.virosa_DW147584#1_P-Class | 454 | 455 |
| A.thaliana_AT2G23990.1#1_NDL | 456 | 457 |
| A.thaliana_AT2G25060.1#1_NDL | 458 | 459 |
| A.thaliana_AT4G31840.1#1_NDL | 460 | 461 |
| C.sativus_CK085664#1_NDL | 462 | 463 |
| C.sinensis_TC4954#1_NDL | 464 | 465 |
| P.trichocarpa_669166#1_NDL | 466 | 467 |
| L.japonicus_TC34883#1_NDL | 468 | 469 |
| P.persica_TC6359#1_NDL | 470 | 471 |
| F.vesca_TA9813_57918#1_NDL | 472 | 473 |
| M.truncatula_AC143339_7.5#1_NDL | 474 | 475 |
| S.henryi_TA1001_13258#1_NDL | 476 | 477 |
| M.crystallinum_TC7817#1_NDL | 478 | 479 |
| A.thaliana_AT3G20570.1#1_NDL | 480 | 481 |
| M.truncatula_AC202319_3.4#1_NDL | 482 | 483 |
| H.paradoxus_TA4880_73304#1_NDL | 484 | 485 |
| L.perennis_DW075689#1_NDL | 486 | 487 |
| S.tuberosum_TC170270#1_NDL | 488 | 489 |
| V.vinifera_GSVIVT00027380001#1_NDL | 490 | 491 |
| P.trichocarpa_571501#1_NDL | 492 | 493 |
| R.communis_TA4149_3988#1_NDL | 494 | 495 |
| M.crystallinum_TC10463#1_NDL | 496 | 497 |
| Z.officinale_TA6894_94328#1_NDL | 498 | 499 |
| O.sativa_LOC_Os01g57880.1#1_NDL | 500 | 501 |
| S.bicolor_Sb04g004360.1#1_NDL | 502 | 503 |
| C.clementina_TC6769#1_Oz | 504 | 505 |
| H.brasiliensis_TA329_3981#1_Oz | 506 | 507 |
| L.japonicus_TC35544#1_Oz | 508 | 509 |
| H.tuberosus_TA3846_4233#1_Oz | 510 | 511 |
| H.exilis_TA3895_400408#1_Oz | 512 | 513 |
| T.aestivum_TC309777#1_Oz | 514 | 515 |
| H.ciliaris_TA2829_73280#1_Oz | 516 | 517 |
| Triphysaria_sp_TC728#1_Oz | 518 | 519 |
| V.vinifera_GSVIVT00023717001#1_Oz | 520 | 521 |
| N.benthamiana_TC12249#1_Oz | 522 | 523 |
| C.sinensis_TC10549#1_Oz | 524 | 525 |
| M.polymorpha_BJ870068#1_Oz | 526 | 527 |
| B.vulgaris_BQ584719#1_Oz | 528 | 529 |

In some instances, related sequences have tentatively been assembled and publicly disclosed by research institutions, such as The Institute for Genomic Research (TIGR; beginning with TA). The Eukaryotic Gene Orthologs (EGO) database may be used to identify such related sequences, either by keyword search or by using the BLAST algorithm with the nucleic acid sequence or polypeptide sequence of interest. On other instances, special nucleic acid sequence databases have been created for particular organisms, such as by the Joint Genome Institute. Further, access to proprietary databases, has allowed the identification of novel nucleic acid and polypeptide sequences.

1.6. Glomalin Polypeptides

Table A6 provides a list of nucleic acid and polypeptide sequences related to SEQ ID NO: 545 and SEQ ID NO: 546.

TABLE A6

Examples of Glomalin nucleic acids and polypeptides:

| Name | Nucleic acid SEQ ID NO: | Polypeptide SEQ ID NO: |
|---|---|---|
| O.sativa_glomalin | 545 | 546 |
| A.cepa_CF435092 | 547 | 571 |
| A.thaliana_AT3G13860.1 | 548 | 572 |
| A.thaliana_AT2G33210.1 | 549 | 573 |
| A.thaliana_AT3G23990.1 | 550 | 574 |
| M.truncatula_AC161864_24.5 | 551 | 575 |
| M.truncatula_AC161864_3.5 | 552 | 576 |
| O.sativa_LOC_Os05g46290.1 | 553 | 577 |
| O.sativa_LOC_Os10g32550.1 | 554 | 578 |
| O.sativa_LOC_Os03g04970.1 | 555 | 579 |
| P.patens_226792 | 556 | 580 |
| P.patens_233067 | 557 | 581 |
| P.patens_163173 | 558 | 582 |
| P.patens_56767 | 559 | 583 |
| P.trichocarpa_scaff_I.447 | 560 | 584 |
| P.trichocarpa_scaff_III.1436 | 561 | 585 |
| P.trichocarpa_scaff_44.102 | 562 | 586 |
| P.trichocarpa_scaff_II.2576 | 563 | 587 |
| S.lycopersicum_TC204816 | 564 | 588 |
| S.lycopersicum_TC197855 | 565 | 589 |
| S.lycopersicum_TC192865 | 566 | 590 |
| Lesculentum_gl_39 | 567 | 591 |
| T.aestivum_c54647991@12535 | 568 | 592 |
| Z.mays_ZM07MC32795_BFb0311C05@32697 | 569 | 593 |
| Z.mays_ZM07MC22894_BFb0229L19@22830 | 570 | 594 |

Sequences have been tentatively assembled and publicly disclosed by research institutions, such as The Institute for Genomic Research (TIGR; beginning with TA). The Eukaryotic Gene Orthologs (EGO) database may be used to identify such related sequences, either by keyword search or by using the BLAST algorithm with the nucleic acid sequence or polypeptide sequence of interest. Special nucleic acid sequence databases have been created for particular organisms, such as by the Joint Genome Institute. Furthermore, access to proprietary databases, has allowed the identification of novel nucleic acid and polypeptide sequences.

Example 2

Alignment of Sequences Related to the Polypeptide Sequences Used in the Methods of the Invention 2.1. eRF1 Polypeptides Alignment of polypeptide sequences was performed using the ClustalW 2.0 algorithm of progressive alignment (Thompson et al. (1997) Nucleic Acids Res 25:4876-4882; Chenna et al. (2003). Nucleic Acids Res 31:3497-3500) with standard setting (slow alignment, similarity matrix: Gonnet (or Blosum 62 (if polypeptides are aligned), gap opening penalty 10, gap extension penalty: 0.2).

Figure 1:
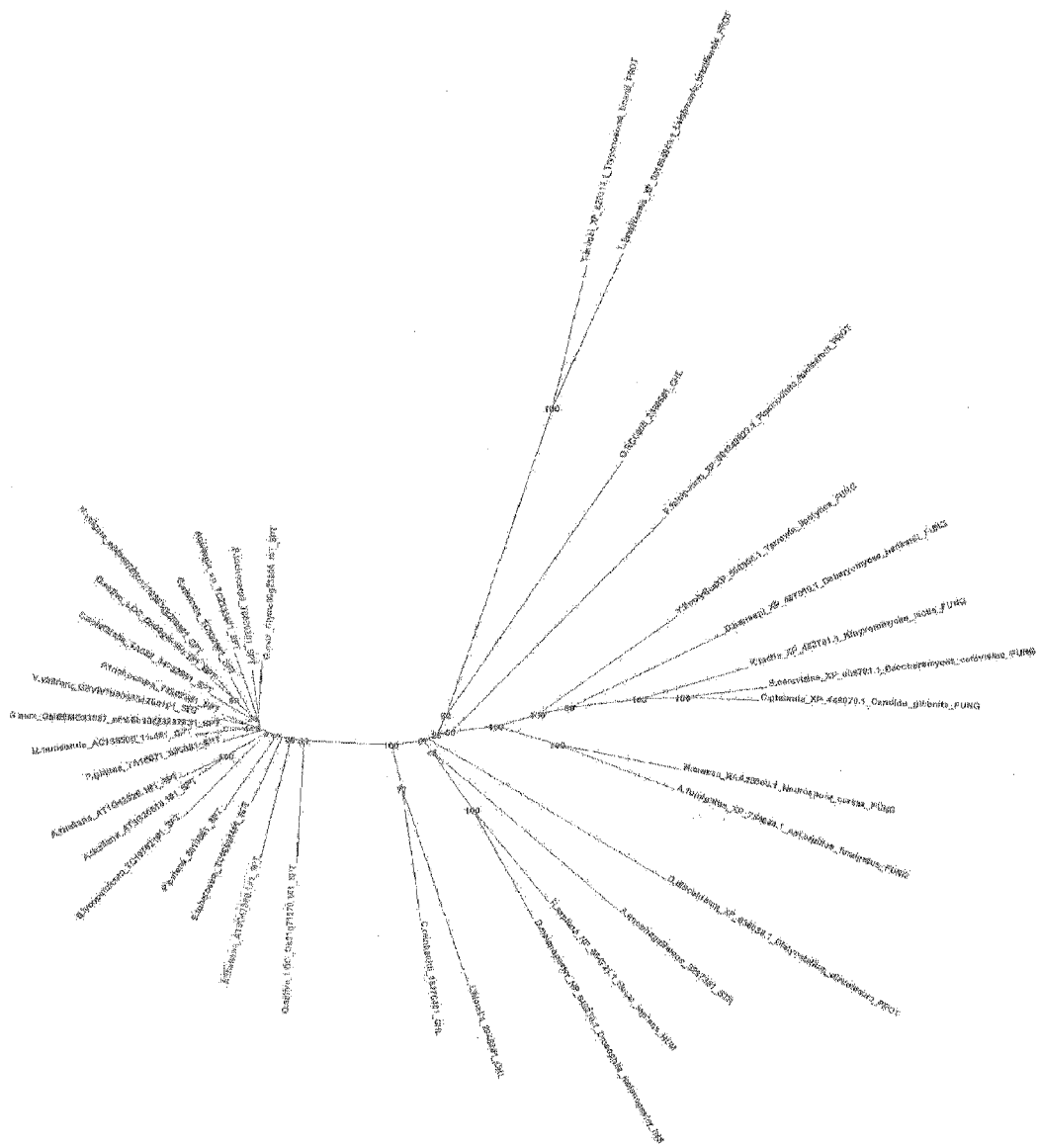
FIG. 1 represents the Phylogenetic tree of selected eRF1 proteins for the different clusters: Proteins of Streptophyta origins and non-Streptophyta origins are indicated. SPT=Streptophyta, CHL=chlorophyta, STR=Stramenopile, BAC=bacteria, FUNGI=fungi, HUM=human, PROT=protozoa. The alignment was generated using MAFFT (Katoh and Toh (2008) Briefings in Bioinformatics 9:286-298). A neighbour-joining tree was calculated using QuickTree (Howe et al. (2002), Bioinformatics 18(11): 1546-7), 100 bootstrap repetitions. The circular phylogram was drawn using Dendroscope (Huson et al. (2007), BMC Bioinformatics 8(1):460). Confidence for 100 bootstrap repetitions is indicated for major branching. Major branching position is indicated by circles.

A phylogenetic tree of eRF1 polypeptide (FIG. 1) was constructed using a neighbour-joining clustering algorithm as provided in the AlignX programme from the Vector NTI (Invitrogen).

2.2. SCAMP-Like Polypeptides

Alignment of polypeptide sequences was performed using the Clustal W1.8 algorithm of progressive alignment (Thompson et al. (1997) Nucleic Acids Res 25:4876-4882; Chenna et al. (2003). Nucleic Acids Res 31:3497-3500) with the setting: gap opening penalty 10, gap extension penalty: 0.2). Minor manual editing was done to further optimise the alignment. The SCAMP-LIKE polypeptides are aligned in FIG. 3.

2.3. Fibrillin Polypeptides

Alignment of polypeptide sequences was performed using the AlignX programme from the Vector NTI (Invitrogen) with standard setting. Minor manual editing was done to further optimise the alignment. The fibrillin polypeptides are aligned in FIG. 5.

A phylogenetic tree of fibrillin polypeptides (FIG. 6) was constructed using a neighbour-joining clustering algorithm as provided in the AlignX programme from the Vector NTI (Invitrogen).

2.4. PLATZ Polypeptides

Alignment of polypeptide sequences was performed using the ClustalW 2.0 algorithm of progressive alignment (Thompson et al. (1997) Nucleic Acids Res 25:4876-4882; Chenna et al. (2003). Nucleic Acids Res 31:3497-3500) with standard setting (slow alignment, similarity matrix: Gonnet, gap opening penalty 10, gap extension penalty: 0.2). Minor manual editing was done to further optimise the alignment. The PLATZ polypeptides are aligned in FIG. 11.

This alignment can be used for determining conserved signature sequences of about 5 to 10 amino acids in length. Preferably the conserved regions of the proteins are used, recognisable by the asterisks (identical residues), the colons (highly conserved substitutions) and the dots (conserved substitutions).

A phylogenetic tree of PLATZ polypeptides (FIG. 12) was constructed using MAFFT (Katoh and Toh (2008) Briefings in Bioinformatics 9:286-298). A neighbour-joining tree was calculated using QuickTree (Howe et al. (2002), Bioinformatics 18(11): 1546-7), 100 bootstrap repetitions. The circular phylogram was drawn using Dendroscope (Huson et al. (2007), BMC Bioinformatics 8(1):460). Confidence for 100 bootstrap repetitions is indicated for major branching.

2.5. PLST-Like Polypeptides

Alignment of polypeptide sequences was performed using the ClustalW 2.0 algorithm of progressive alignment (Thompson et al. (1997) Nucleic Acids Res 25:4876-4882; Chenna et al. (2003). Nucleic Acids Res 31:3497-3500) with standard setting (slow alignment, similarity matrix: Gonnet (or Blosum 62 (if polypeptides are aligned), gap opening penalty 10, gap extension penalty: 0.2).

A phylogenetic tree of PLST-like polypeptide (FIG. 15) was constructed using a neighbour-joining clustering algorithm as provided in the AlignX programme from the Vector NTI (Invitrogen).

2.6. Glomalin Polypeptides

Alignment of polypeptide sequences was performed using the ClustalW 2.0 algorithm of progressive alignment (Thompson et al. (1997) Nucleic Acids Res 25:4876-4882; Chenna et al. (2003). Nucleic Acids Res 31:3497-3500) with standard setting (slow alignment, similarity matrix: Gonnet, gap opening penalty 10, gap extension penalty: 0.2). Minor manual editing was done to further optimise the alignment. The Glomalin polypeptides are aligned in FIG. 18.

A phylogenetic tree of Glomalin polypeptides (FIG. 19) was constructed using a neighbour-joining clustering algorithm as provided in the AlignX programme from the Vector NTI (Invitrogen).

Example 3

Calculation of Global Percentage Identity Between Polypeptide Sequences Useful in Performing the Methods of the Invention 3.1. eRF1 Polypeptides Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:
Scoring matrix: Blosum62
First Gap: 12
Extending gap: 2

Results of the software analysis are shown in Table B1 for the global similarity and identity over the full length of the polypeptide sequences. Percentage identity is given above the diagonal in bold and percentage similarity is given below the diagonal (normal face).

The percentage identity between the eRF1 polypeptide sequences useful in performing the methods of the invention can be as low as 49% amino acid identity compared to SEQ ID NO: 2.

3.2. SCAMP-Like Polypeptides

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters typically used in the comparison are:
Scoring matrix: Blosum62
First Gap: 12
Extending gap: 2

3.3. Fibrillin Polypeptides

Global percentages of similarity and identity between full length polypeptide sequences useful in performing the methods of the invention were determined using the MatGAT

TABLE B1

MatGAT results for global similarity and identity over the full length of the polypeptide sequences.

| | 1 | 2 | 3 | 4 | 5 | 6 | 7 | 8 | 9 | 10 |
|---|---|---|---|---|---|---|---|---|---|---|
| 1. A.thaliana__AT1G12920.1 | | 95.00 | 86.00 | 88.00 | 89.00 | 89.00 | 89.00 | 90.00 | 89.00 | 91.00 |
| 2. A.thaliana__AT3G26618.1 | | | 86.00 | 90.00 | 91.00 | 90.00 | 90.00 | 93.00 | 90.00 | 92.00 |
| 3. A.thaliana__AT5G47880.1 | | | | 87.00 | 87.00 | 87.00 | 89.00 | 88.00 | 86.00 | 85.00 |
| 4. Aquilegia_sp__TC23338 | | | | | 91.00 | 92.00 | 91.00 | 93.00 | 90.00 | 92.00 |
| 5. C.sinensis__TC9326 | | | | | | 94.00 | 92.00 | 96.00 | 92.00 | 92.00 |
| 6. C.solstitialis__TA682__347529 | | | | | | | 93.00 | 94.00 | 92.00 | 91.00 |
| 7. G.max__Glyma09g29600.1 | | | | | | | | 93.00 | 91.00 | 91.00 |
| 8. G.max__GM06MC33657__sm55b10 | | | | | | | | | 92.00 | 95.00 |
| 9. H.vulgare__c64960768hv270303 | | | | | | | | | | 89.00 |
| 10. M.truncatula__AC136505__11.4 | | | | | | | | | | |
| 11. O.sativa__LOC__Os01g71270.1 | | | | | | | | | | |
| 12. O.sativa__LOC__Os03g49580.1 | | | | | | | | | | |
| 13. P.glauca__TA15071__3330 | | | | | | | | | | |
| 14. P.patens__58108 | | | | | | | | | | |
| 15. P.trichocarpa__708902 | | | | | | | | | | |
| 16. P.trichocarpa__732023 | | | | | | | | | | |
| 17. S.lycopersicum__TC197021 | | | | | | | | | | |
| 18. S.tuberosum__TC166984 | | | | | | | | | | |
| 19. V.vinifera__GSVIVT00014642001 | | | | | | | | | | |

| | 11 | 12 | 13 | 14 | 15 | 16 | 17 | 18 | 19 |
|---|---|---|---|---|---|---|---|---|---|
| 1. A.thaliana__AT1G12920.1 | 85.00 | 90.00 | 91.00 | 87.00 | 91.00 | 91.00 | 87.00 | 89.00 | 90.00 |
| 2. A.thaliana__AT3G26618.1 | 85.00 | 91.00 | 93.00 | 88.00 | 91.00 | 93.00 | 88.00 | 90.00 | 91.00 |
| 3. A.thaliana__AT5G47880.1 | 84.00 | 87.00 | 87.00 | 87.00 | 88.00 | 87.00 | 84.00 | 89.00 | 88.00 |
| 4. Aquilegia_sp__TC23338 | 85.00 | 92.00 | 92.00 | 87.00 | 92.00 | 92.00 | 88.00 | 90.00 | 92.00 |
| 5. C.sinensis__TC9326 | 87.00 | 95.00 | 95.00 | 89.00 | 92.00 | 95.00 | 89.00 | 90.00 | 94.00 |
| 6. C.solstitialis__TA682__347529 | 86.00 | 93.00 | 94.00 | 89.00 | 93.00 | 94.00 | 89.00 | 91.00 | 94.00 |
| 7. G.max__Glyma09g29600.1 | 86.00 | 92.00 | 93.00 | 89.00 | 94.00 | 93.00 | 88.00 | 92.00 | 94.00 |
| 8. G.max__GM06MC33657__sm55b10 | 87.00 | 94.00 | 95.00 | 90.00 | 94.00 | 96.00 | 91.00 | 92.00 | 95.00 |
| 9. H.vulgare__c64960768hv270303 | 87.00 | 95.00 | 92.00 | 87.00 | 91.00 | 92.00 | 87.00 | 90.00 | 90.00 |
| 10. M.truncatula__AC136505__11.4 | 86.00 | 91.00 | 93.00 | 88.00 | 92.00 | 94.00 | 89.00 | 90.00 | 93.00 |
| 11. O.sativa__LOC__Os01g71270.1 | | 87.00 | 87.00 | 83.00 | 87.00 | 86.00 | 84.00 | 87.00 | 86.00 |
| 12. O.sativa__LOC__Os03g49580.1 | | | 93.00 | 89.00 | 93.00 | 93.00 | 89.00 | 92.00 | 92.00 |
| 13. P.glauca__TA15071__3330 | | | | 91.00 | 93.00 | 95.00 | 90.00 | 91.00 | 95.00 |
| 14. P.patens__58108 | | | | | 89.00 | 90.00 | 86.00 | 88.00 | 89.00 |
| 15. P.trichocarpa__708902 | | | | | | 94.00 | 90.00 | 91.00 | 96.00 |
| 16. P.trichocarpa__732023 | | | | | | | 90.00 | 91.00 | 96.00 |
| 17. S.lycopersicum__TC197021 | | | | | | | | 87.00 | 90.00 |
| 18. S.tuberosum__TC166984 | | | | | | | | | 91.00 |
| 19. V.vinifera__GSVIVT00014642001 | | | | | | | | | |

(Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix.

Sequence similarity is shown in the bottom half of the dividing line and sequence identity is shown in the top half of the diagonal dividing line.

Parameters used in the comparison were:
Scoring matrix: Blosum62
First Gap: 12
Extending gap: 2

Results of the software analysis are shown in Table B2 for the global similarity and identity over the full length of the polypeptide sequences. Percentage identity is given above the diagonal and percentage similarity is given below the diagonal.

TABLE B2

MatGAT results for global similarity and identity over the full length of the polypeptide sequences.

| | 1 | 2 | 3 | 4 | 5 | 6 | 7 | 8 | 9 | 10 | 11 | 12 | 13 | 14 | 15 |
|---|---|---|---|---|---|---|---|---|---|---|---|---|---|---|---|
| 1. L.esculentum_QC | | 61 | 61 | 31 | 61 | 30 | 28 | 62 | 62 | 62 | 61 | 61 | 61 | 89 | 53 |
| 2. A.thaliana_AT2G46910.1 | 78 | | 89 | 31 | 62 | 29 | 26 | 68 | 61 | 61 | 67 | 60 | 65 | 64 | 58 |
| 3. B.napus_BN06MC20042_46499279 | 77 | 93 | | 32 | 62 | 29 | 27 | 67 | 61 | 61 | 65 | 61 | 65 | 63 | 59 |
| 4. C.reinhardtii_190008 | 50 | 51 | 50 | | 32 | 30 | 29 | 34 | 30 | 30 | 33 | 31 | 30 | 32 | 32 |
| 5. C.solstitialis_TA2061_347529 | 78 | 79 | 78 | 52 | | 31 | 28 | 62 | 64 | 64 | 61 | 80 | 63 | 64 | 54 |
| 6. C.vulgaris_102074 | 47 | 45 | 46 | 47 | 45 | | 43 | 28 | 29 | 29 | 28 | 28 | 28 | 28 | 28 |
| 7. Chlorella_141300 | 45 | 44 | 44 | 41 | 43 | 63 | | 30 | 26 | 26 | 29 | 27 | 28 | 28 | 26 |
| 8. G.hirsutum_TC97719 | 77 | 81 | 80 | 53 | 76 | 46 | 45 | | 67 | 66 | 99 | 61 | 73 | 61 | 61 |
| 9. G.max_Glyma07g00410.1 | 78 | 78 | 76 | 51 | 78 | 47 | 43 | 79 | | 99 | 65 | 66 | 70 | 62 | 59 |
| 10. G.max_GM06MC19234_59694709 | 78 | 77 | 75 | 51 | 78 | 46 | 43 | 78 | 100 | | 65 | 65 | 69 | 62 | 58 |
| 11. G.raimondii_TC7628 | 77 | 80 | 79 | 53 | 75 | 45 | 44 | 99 | 78 | 77 | | 59 | 72 | 60 | 59 |
| 12. L.virosa_DW148855 | 77 | 77 | 77 | 52 | 88 | 43 | 42 | 75 | 79 | 79 | 74 | | 64 | 63 | 52 |
| 13. M.domestica_TC4908 | 77 | 82 | 82 | 50 | 76 | 45 | 46 | 85 | 82 | 81 | 84 | 77 | | 62 | 61 |
| 14. N.tabacum_TC21276 | 93 | 80 | 80 | 51 | 79 | 47 | 45 | 77 | 80 | 80 | 76 | 78 | 78 | | 55 |
| 15. O.sativa_AK241632.1 | 71 | 71 | 73 | 50 | 71 | 41 | 42 | 72 | 73 | 72 | 71 | 71 | 75 | 72 | |
| 16. O.taurii_36262 | 48 | 50 | 50 | 48 | 51 | 40 | 38 | 52 | 49 | 48 | 52 | 49 | 52 | 48 | 51 |
| 17. P.patens_202760 | 55 | 57 | 56 | 45 | 55 | 34 | 36 | 57 | 56 | 55 | 56 | 56 | 58 | 57 | 57 |
| 18. P.sitchensis_TA14105_3332 | 63 | 66 | 66 | 48 | 66 | 36 | 34 | 64 | 65 | 64 | 63 | 66 | 66 | 63 | 66 |
| 19. P.trichocarpa_552393 | 64 | 69 | 67 | 43 | 62 | 38 | 35 | 68 | 64 | 64 | 67 | 62 | 69 | 64 | 61 |
| 20. S.bicolor_Sb01g017450.1 | 70 | 73 | 72 | 54 | 72 | 42 | 42 | 75 | 72 | 72 | 74 | 71 | 74 | 73 | 87 |
| 21. S.moellendorffii_422148 | 63 | 63 | 66 | 49 | 65 | 51 | 49 | 62 | 65 | 64 | 61 | 63 | 64 | 67 | 60 |
| 22. T.pratense_TA1297_57577 | 78 | 79 | 76 | 48 | 74 | 42 | 41 | 77 | 82 | 82 | 76 | 77 | 79 | 79 | 73 |
| 23. V.vinifera_GSVIVT00026214001 | 76 | 78 | 78 | 49 | 76 | 47 | 43 | 80 | 77 | 77 | 79 | 75 | 80 | 77 | 72 |
| 24. Z.mays_TC447544 | 69 | 71 | 70 | 51 | 70 | 40 | 41 | 72 | 71 | 70 | 71 | 71 | 73 | 71 | 85 |
| 25. AT4G04020.1 Symbols: FIB FIB (FIBRILLIN); structural molecule chr4: 1932159-1933544 | 37 | 40 | 41 | 41 | 37 | 31 | 28 | 40 | | 38 | 37 | 40 | 39 | 41 | 37 | 41 |
| 26. AT4G22240.1 Symbols: plastid-lipid associated protein PAP, putative chr4: 11766102- | 39 | 45 | 42 | 40 | 40 | 31 | 29 | 43 | | 40 | 39 | 43 | 43 | 43 | 40 | 42 |
| 27. AT3G23400.1 Symbols: plastid-lipid associated protein PAP/fibrillin family protein | 40 | 40 | 39 | 39 | 40 | 29 | 29 | 40 | | 41 | 41 | 40 | 40 | 42 | 41 | 39 |
| 28. AT2G35490.1 Symbols: plastid-lipid associated protein PAP, putative chr2: 14919388- | 33 | 35 | 36 | 32 | 35 | 24 | 26 | 36 | | 35 | 35 | 37 | 36 | 35 | 34 | 33 |
| 29. AT3G58010.1 Symbols: Identical to Probable plastid-lipid-associated protein 9, | 29 | 29 | 27 | 27 | 29 | 23 | 21 | 27 | | 30 | 30 | 27 | 28 | 31 | 29 | 31 |
| 30. AT2G42130.3 Symbols: Identical to Probable plastid-lipid-associated protein 13, | 31 | 28 | 28 | 31 | 29 | 24 | 26 | 29 | | 27 | 29 | 28 | 29 | 31 | 31 | 29 |

| | 16 | 17 | 18 | 19 | 20 | 21 | 22 | 23 | 24 | 25 | 26 | 27 | 28 | 29 | 30 |
|---|---|---|---|---|---|---|---|---|---|---|---|---|---|---|---|
| 1. L.esculentum_QC | 33 | 38 | 48 | 51 | 54 | 47 | 60 | 62 | 52 | 20 | 19 | 21 | 19 | 15 | 16 |
| 2. A.thaliana_AT2G46910.1 | 33 | 39 | 48 | 56 | 60 | 45 | 62 | 63 | 57 | 23 | 26 | 23 | 22 | 16 | 15 |
| 3. B.napus_BN06MC20042_46499279 | 34 | 39 | 49 | 54 | 59 | 48 | 60 | 63 | 58 | 24 | 25 | 23 | 20 | 17 | 16 |
| 4. C.reinhardtii_190008 | 34 | 30 | 31 | 29 | 35 | 35 | 28 | 30 | 32 | 23 | 22 | 23 | 17 | 14 | 19 |
| 5. C.solstitialis_TA2061_347529 | 37 | 37 | 50 | 54 | 56 | 51 | 59 | 62 | 54 | 23 | 24 | 23 | 20 | 16 | 16 |
| 6. C.vulgaris_102074 | 28 | 24 | 26 | 24 | 27 | 34 | 28 | 27 | 27 | 17 | 17 | 17 | 14 | 13 | 12 |
| 7. Chlorella_141300 | 27 | 23 | 22 | 23 | 27 | 33 | 25 | 26 | 26 | 17 | 17 | 19 | 17 | 12 | 16 |
| 8. G.hirsutum_TC97719 | 35 | 40 | 47 | 59 | 62 | 47 | 64 | 69 | 60 | 22 | 23 | 23 | 22 | 15 | 16 |
| 9. G.max_Glyma07g00410.1 | 34 | 39 | 47 | 55 | 57 | 46 | 74 | 66 | 56 | 22 | 22 | 23 | 21 | 16 | 16 |
| 10. G.max_GM06MC19234_59694709 | 34 | 39 | 46 | 54 | 57 | 45 | 73 | 66 | 55 | 22 | 22 | 23 | 20 | 17 | 16 |
| 11. G.raimondii_TC7628 | 34 | 41 | 46 | 58 | 61 | 45 | 63 | 67 | 58 | 21 | 22 | 22 | 22 | 16 | 15 |
| 12. L.virosa_DW148855 | 34 | 38 | 50 | 52 | 55 | 49 | 61 | 62 | 53 | 22 | 24 | 23 | 21 | 15 | 16 |
| 13. M.domestica_TC4908 | 35 | 41 | 49 | 56 | 62 | 48 | 66 | 73 | 61 | 22 | 23 | 24 | 22 | 17 | 15 |
| 14. N.tabacum_TC21276 | 33 | 38 | 48 | 52 | 56 | 50 | 61 | 63 | 55 | 21 | 22 | 22 | 20 | 16 | 15 |
| 15. O.sativa_AK241632.1 | 34 | 42 | 50 | 49 | 80 | 46 | 57 | 59 | 79 | 25 | 23 | 23 | 21 | 18 | 17 |

TABLE B2-continued

MatGAT results for global similarity and identity over the full length of the polypeptide sequences.

| | | | | | | | | | | | | | | | |
|---|---|---|---|---|---|---|---|---|---|---|---|---|---|---|---|
| 16. O.taurii__36262 | | 31 | 32 | 29 | 36 | 31 | 34 | 35 | 34 | 21 | 20 | 23 | 21 | 17 | 16 |
| 17. P.patens__202760 | 48 | | 43 | 34 | 41 | 42 | 39 | 40 | 42 | 20 | 21 | 20 | 19 | 16 | 15 |
| 18. P.sitchensis__TA14105__3332 | 49 | 58 | | 40 | 52 | 45 | 48 | 49 | 51 | 22 | 23 | 21 | 22 | 16 | 16 |
| 19. P.trichocarpa__552393 | 48 | 55 | 59 | | 48 | 38 | 51 | 57 | 47 | 17 | 18 | 20 | 19 | 17 | 15 |
| 20. S.bicolor__Sb01g017450.1 | 52 | 56 | 64 | 61 | | 48 | 56 | 59 | 90 | 22 | 24 | 25 | 21 | 18 | 16 |
| 21. S.moellendorffii__422148 | 47 | 57 | 58 | 50 | 60 | | 44 | 47 | 46 | 22 | 23 | 20 | 18 | 15 | 14 |
| 22. T.pratense__TA1297__57577 | 51 | 56 | 66 | 66 | 75 | 62 | | 60 | 54 | 20 | 21 | 24 | 20 | 15 | 16 |
| 23. V.vinifera__GSVIVT00026214001 | 51 | 54 | 65 | 67 | 72 | 63 | 75 | | 57 | 21 | 24 | 24 | 19 | 18 | 16 |
| 24. Z.mays__TC447544 | 50 | 57 | 64 | 60 | 92 | 60 | 69 | 69 | | 22 | 24 | 25 | 21 | 19 | 18 |
| 25. AT4G04020.1 Symbols: FIB FIB (FIBRILLIN); structural molecule chr4: 1932159-1933544 | 39 | 39 | 42 | 37 | 39 | 37 | 40 | 38 | 40 | | 75 | 22 | 39 | 19 | 20 |
| 26. AT4G22240.1 Symbols: plastid-lipid associated protein PAP, putative chr4: 11766102- | 40 | 40 | 41 | 38 | 43 | 39 | 40 | 42 | 43 | 83 | | 23 | 38 | 16 | 18 |
| 27. AT3G23400.1 Symbols: plastid-lipid associated protein PAP/fibrillin family protein | 40 | 36 | 38 | 35 | 42 | 35 | 41 | 41 | 41 | 37 | 39 | | 25 | 18 | 15 |
| 28. AT2G35490.1 Symbols: plastid-lipid associated protein PAP, putative chr2: 14919388- | 35 | 36 | 37 | 35 | 34 | 30 | 35 | 35 | 35 | 53 | 51 | 35 | | 18 | 19 |
| 29. AT3G58010.1 Symbols: Identical to Probable plastid-lipid-associated protein 9, | 31 | 31 | 29 | 31 | 29 | 26 | 33 | 28 | 29 | 34 | 32 | 31 | 34 | | 67 |
| 30. AT2G42130.3 Symbols: Identical to Probable plastid-lipid-associated protein 13, | 31 | 32 | 29 | 31 | 28 | 26 | 33 | 29 | 30 | 37 | 32 | 30 | 35 | 79 | |

A MATGAT table for local alignment of a specific domain for example over the PAP fibrillin domain or over the C-terminal domain, or data on % identity/similarity between specific domains may also be performed.

3.4. PLATZ Polypeptides

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:
Scoring matrix: Blosum62
First Gap: 12
Extending gap: 2

Results of the software analysis are shown in Table B3 for the global similarity and identity over the full length of the polypeptide sequences. Percentage identity is given above the diagonal in bold and percentage similarity is given below the diagonal (normal face).

The percentage identity between the PLATZ-A1-α polypeptide sequences useful in performing the methods of the invention can be as low as 65% amino acid identity compared to SEQ ID NO: 261.

TABLE B3

MatGAT results for global similarity and identity over the full length of the polypeptide sequences.

| | 1 | 2 | 3 | 4 | 5 | 6 | 7 | 8 | 9 | 10 | 11 | 12 | 13 | 14 |
|---|---|---|---|---|---|---|---|---|---|---|---|---|---|---|
| 1. AsTA310__217475 | | 55.4 | 67.1 | 65.0 | 66.7 | 62.7 | 55.6 | 57.2 | 65.2 | 64.8 | 57.4 | 56.7 | 62.9 | 57.1 |
| 2. AT2G12646.1 | 65.6 | | 66.3 | 68.3 | 68.3 | 65.8 | 63.7 | 62.1 | 72.3 | 70.7 | 60.9 | 62.2 | 65.9 | 61.4 |
| 3. Gm09g12330.1 | 74.5 | 80.5 | | 87.4 | 86.7 | 81.0 | 71.4 | 72.0 | 81.3 | 80.5 | 72.8 | 70.4 | 81.3 | 72.1 |
| 4. Gm13g23360.1 | 72.5 | 82.8 | 90.3 | | 98.0 | 86.5 | 74.6 | 70.0 | 82.1 | 81.7 | 70.9 | 68.1 | 83.7 | 69.8 |
| 5. Gm17g11470.1 | 72.6 | 82.4 | 90.3 | 98.4 | | 86.5 | 74.6 | 69.8 | 82.1 | 81.7 | 70.6 | 67.9 | 82.5 | 69.5 |
| 6. MtAC152347__6.5 | 70.2 | 80.1 | 86.9 | 92.9 | 92.9 | | 72.5 | 67.1 | 77.0 | 77.0 | 67.5 | 65.6 | 75.7 | 66.8 |
| 7. NtTC27363 | 63.2 | 81.3 | 79.4 | 83.8 | 83.4 | 83.8 | | 69.6 | 75.9 | 75.9 | 69.4 | 66.8 | 75.3 | 68.8 |
| 8. Os02g09070.1 | 69.4 | 76.6 | 82.4 | 82.2 | 81.9 | 79.4 | 79.4 | | 72.8 | 72.4 | 94.9 | 91.1 | 71.8 | 93.2 |
| 9. Pt583639 | 70.8 | 85.5 | 88.1 | 88.7 | 88.7 | 86.5 | 84.6 | 83.1 | | 93.4 | 71.4 | 70.3 | 82.4 | 70.7 |
| 10. Pt779642 | 70.0 | 84.0 | 86.4 | 87.9 | 87.9 | 86.1 | 84.6 | 81.9 | 96.3 | | 71.0 | 71.1 | 83.3 | 70.3 |

TABLE B3-continued

MatGAT results for global similarity and identity over the full length of the polypeptide sequences.

|  | 1 | 2 | 3 | 4 | 5 | 6 | 7 | 8 | 9 | 10 | 11 | 12 | 13 | 14 |
|---|---|---|---|---|---|---|---|---|---|---|---|---|---|---|
| 11. Sb04g005680.1 | 68.6 | 77.0 | 83.7 | 83.0 | 82.7 | 80.2 | 80.6 | 97.0 | 82.3 | 81.5 |  | 90.7 | 73.1 | 95.4 |
| 12. TaTC339412 | 66.7 | 78.1 | 82.0 | 81.8 | 81.9 | 79.4 | 78.3 | 94.5 | 83.5 | 82.3 | 94.9 |  | 70.3 | 91.1 |
| 13. VvT00005658001 | 70.2 | 81.3 | 85.7 | 91.9 | 91.1 | 86.9 | 84.6 | 82.0 | 89.8 | 89.0 | 84.1 | 81.6 |  | 72.8 |
| 14. Zm376 | 66.7 | 77.0 | 82.8 | 82.2 | 82.3 | 79.8 | 79.4 | 95.4 | 82.3 | 81.5 | 96.6 | 95.4 | 82.9 |  |

3.5. PLST-Like Polypeptides

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:
Scoring matrix: Blosum62
First Gap: 12
Extending gap: 2

Results of the software analysis are shown in Table B4 for the global similarity and identity over the full length of the polypeptide sequences. Percentage identity is given above the diagonal in bold and percentage similarity is given below the diagonal (normal face).

The percentage identity between the PLST-like polypeptide sequences useful in performing the methods of the invention can be as low as 49% amino acid identity compared to SEQ ID NO: 411.

3.6. Glomalin Polypeptides

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were: Scoring matrix: Blosum62; First Gap: 12; Extending gap: 2

Results of the software analysis are shown in Table B for the global similarity and identity over the full length of the polypeptide sequences. Percentage identity is given above the diagonal in bold and percentage similarity is given below the diagonal (normal face).

The sequence identity (in %) between the Glomalin polypeptide sequences useful in performing the methods of the invention is generally higher than 50% compared to SEQ ID NO: 546.

TABLE B4

MatGAT results for global similarity and identity over the full length of the polypeptide sequences.

|  | 1 | 2 | 3 | 4 | 5 | 6 | 7 | 8 | 9 | 10 | 11 | 12 | 13 | 14 | 15 | 16 |
|---|---|---|---|---|---|---|---|---|---|---|---|---|---|---|---|---|
| 1. A.thaliana__AT1G64640.1#1 |  | 81 | 45 | 47 | 51 | 49 | 51 | 48 | 39 | 45 | 47 | 49 | 32 | 41 | 42 | 38 |
| 2. B.napus__BN06MC03188__42122333 |  |  | 44 | 50 | 56 | 49 | 53 | 50 | 41 | 47 | 46 | 47 | 32 | 39 | 38 | 38 |
| 3. C.canephora__TC195#1 |  |  |  | 57 | 59 | 61 | 55 | 53 | 45 | 48 | 57 | 50 | 30 | 36 | 39 | 41 |
| 4. G.hirsutum__DW500755#1 |  |  |  |  | 68 | 67 | 65 | 53 | 46 | 51 | 56 | 56 | 35 | 36 | 38 | 41 |
| 5. M.domestica__TC10680#1 |  |  |  |  |  | 71 | 67 | 61 | 45 | 52 | 57 | 57 | 33 | 37 | 38 | 40 |
| 6. V.vinifera__GSVIVT00000537001#1 |  |  |  |  |  |  | 71 | 56 | 43 | 53 | 57 | 54 | 31 | 36 | 36 | 40 |
| 7. P.trichocarpa__scaff__I.715#1 |  |  |  |  |  |  |  | 59 | 48 | 54 | 56 | 58 | 32 | 37 | 37 | 39 |
| 8. G.max__Glyma13g10460.1#1 |  |  |  |  |  |  |  |  | 50 | 45 | 52 | 51 | 30 | 33 | 34 | 38 |
| 9. G.max__GM06MC08447__51315644 |  |  |  |  |  |  |  |  |  | 39 | 40 | 45 | 24 | 27 | 28 | 30 |
| 10. T.erecta__SIN__01b-CS__Scarletade-7-M13.b1 |  |  |  |  |  |  |  |  |  |  | 47 | 49 | 32 | 31 | 37 |
| 11. S.lycopersicum__TC196046#1 |  |  |  |  |  |  |  |  |  |  |  | 53 | 30 | 37 | 36 | 39 |
| 12. Triphysaria_sp__TC7525#1 |  |  |  |  |  |  |  |  |  |  |  |  | 30 | 36 | 32 | 41 |
| 13. H.vulgare__c62931576hv270303 |  |  |  |  |  |  |  |  |  |  |  |  |  | 40 | 39 | 30 |
| 14. O.sativa__LOC__Os03g02400.1#1 |  |  |  |  |  |  |  |  |  |  |  |  |  |  | 66 | 38 |
| 15. Z.mays__ZM07MC02479__58582734 |  |  |  |  |  |  |  |  |  |  |  |  |  |  |  | 37 |
| 16. P.glauca__TA13716__3330#1 |  |  |  |  |  |  |  |  |  |  |  |  |  |  |  |  |

TABLE B5

MatGAT results for global similarity and identity over the full length of the polypeptide sequences.

|  | 1 | 2 | 3 | 4 | 5 | 6 | 7 | 8 | 9 | 10 | 11 | 12 |
|---|---|---|---|---|---|---|---|---|---|---|---|---|
| 1. S.lycopersicum_TC192865 |  | 77.1 | 76.8 | 76.4 | 75.4 | 69.3 | 26.8 | 67.4 | 65.9 | 70.1 | 83.6 | 87.4 |
| 2. P.patens_226792 | 89.1 |  | 92.4 | 89.3 | 83.5 | 67.5 | 26.3 | 64.4 | 63.4 | 66.1 | 76.1 | 76.9 |
| 3. P.patens_233067 | 89.1 | 97.9 |  | 89.3 | 84.2 | 66.4 | 25.5 | 64.7 | 63.7 | 65.8 | 76.1 | 76.9 |
| 4. P.patens_163173 | 87.7 | 95.2 | 95.5 |  | 83.3 | 67.5 | 26.4 | 65.7 | 64.3 | 66.8 | 75.6 | 77.2 |
| 5. P.patens_56767 | 87.6 | 92.9 | 92.8 | 91.4 |  | 66.0 | 25.3 | 64.8 | 64.3 | 66.5 | 74.0 | 75.0 |
| 6. A.thaliana_AT3G13860.1 | 82.9 | 81.7 | 80.9 | 81.4 | 80.3 |  | 31.2 | 69.2 | 69.2 | 79.4 | 67.6 | 70.5 |
| 7. P.trichocarpa_sc_44.102 | 33.2 | 32.4 | 32.2 | 31.7 | 30.7 | 36.2 |  | 27.2 | 26.3 | 30.6 | 26.3 | 27.2 |
| 8. O.sativa_Os05g46290 | 84.3 | 82.3 | 82.6 | 82.6 | 81.9 | 85.2 | 34.3 |  | 88.9 | 71.3 | 66.2 | 68.2 |
| 9. Z.mays_ZM07MC22894 | 83.8 | 81.0 | 81.2 | 81.0 | 81.4 | 85.2 | 32.9 | 95.4 |  | 71.4 | 65.4 | 68.1 |
| 10. S.lycopersicum_TC204816 | 84.1 | 82.4 | 82.1 | 82.4 | 81.9 | 89.5 | 35.4 | 86.4 | 85.9 |  | 68.7 | 72.3 |
| 11. A.thaliana_AT2G33210 | 91.6 | 87.7 | 88.0 | 86.2 | 85.6 | 81.9 | 32.1 | 82.2 | 81.0 | 81.4 |  | 86.0 |
| 12. A.thaliana_AT3G23990 | 94.6 | 89.4 | 89.1 | 88.6 | 87.8 | 83.7 | 33.4 | 85.4 | 84.1 | 84.9 | 92.5 |  |
| 13. L.esculentum_gl_39 | 99.8 | 88.9 | 89.0 | 87.6 | 87.4 | 82.7 | 33.2 | 84.2 | 83.6 | 84.3 | 91.5 | 94.5 |
| 14. S.lycopersicum_TC197855 | 95.2 | 89.1 | 88.3 | 87.1 | 86.7 | 83.9 | 33.5 | 84.9 | 83.4 | 84.8 | 91.6 | 95.8 |
| 15. A.cepa_CF435092 | 24.5 | 23.0 | 22.6 | 22.1 | 22.4 | 21.0 | 49.0 | 21.9 | 20.3 | 21.5 | 23.8 | 24.8 |
| 16. O.sativa_Os10g32550.1 | 85.5 | 81.5 | 82.0 | 80.1 | 80.1 | 76.3 | 30.8 | 77.8 | 76.7 | 77.8 | 83.8 | 86.8 |
| 17. O.sativa_glomalin_SEQID2 | 93.6 | 89.4 | 89.7 | 88.3 | 87.6 | 83.8 | 33.4 | 85.0 | 83.8 | 85.7 | 90.8 | 95.3 |
| 18. Z.mays_ZM07MC32795 | 93.1 | 89.3 | 89.0 | 87.7 | 87.1 | 83.3 | 33.3 | 84.2 | 82.8 | 85.1 | 90.8 | 94.5 |
| 19. O.sativa_Os03g04970.1 | 93.1 | 89.4 | 89.1 | 87.2 | 86.6 | 82.8 | 32.8 | 83.6 | 82.8 | 84.1 | 90.1 | 94.5 |
| 20. T.aestivum_c54647991 | 93.4 | 89.3 | 89.0 | 87.3 | 87.2 | 82.3 | 33.3 | 82.6 | 81.9 | 83.9 | 90.1 | 93.8 |
| 21. P.trichocarpa_sc_I.447 | 56.0 | 52.4 | 52.8 | 52.5 | 51.7 | 49.8 | 56.9 | 50.6 | 48.4 | 51.3 | 55.0 | 56.7 |
| 22. P.trichocarpa_sc_III.1436 | 90.5 | 84.8 | 85.2 | 83.8 | 82.8 | 81.3 | 32.0 | 81.1 | 80.2 | 80.8 | 88.2 | 91.7 |
| 23. M.truncatula_AC161864_24 | 94.6 | 89.1 | 89.5 | 88.7 | 88.3 | 84.3 | 33.4 | 85.5 | 84.0 | 85.5 | 92.1 | 96.0 |
| 24. M.truncatula_AC161864_3 | 94.1 | 88.9 | 89.0 | 88.4 | 87.9 | 83.2 | 33.0 | 84.3 | 82.9 | 84.2 | 92.0 | 95.5 |
| 25. P.trichocarpa_scaff_II.2576 | 93.4 | 88.9 | 87.9 | 87.7 | 86.4 | 83.7 | 33.2 | 84.7 | 83.1 | 84.2 | 89.9 | 93.9 |

|  | 13 | 14 | 15 | 16 | 17 | 18 | 19 | 20 | 21 | 22 | 23 | 24 | 25 |
|---|---|---|---|---|---|---|---|---|---|---|---|---|---|
| 1. S.lycopersicum_TC192865 | 99.8 | 88.6 | 22.1 | 76.7 | 84.8 | 83.3 | 83.4 | 83.2 | 50.6 | 81.7 | 85.3 | 83.6 | 84.7 |
| 2. P.patens_226792 | 76.9 | 76.0 | 19.5 | 69.3 | 76.7 | 75.9 | 75.5 | 75.6 | 43.5 | 72.5 | 75.8 | 76.3 | 75.9 |
| 3. P.patens_233067 | 76.6 | 75.6 | 18.9 | 69.4 | 76.8 | 75.5 | 75.0 | 75.0 | 43.2 | 73.3 | 76.6 | 76.6 | 75.1 |
| 4. P.patens_163173 | 76.1 | 75.0 | 19.4 | 69.4 | 76.7 | 75.6 | 74.6 | 75.0 | 43.9 | 72.9 | 76.7 | 76.5 | 76.4 |
| 5. P.patens_56767 | 75.3 | 73.9 | 18.9 | 68.1 | 75.1 | 73.5 | 72.9 | 73.9 | 43.3 | 71.5 | 75.6 | 74.6 | 74.1 |
| 6. A.thaliana_AT3G13860.1 | 69.1 | 70.2 | 18.2 | 63.6 | 69.7 | 69.2 | 68.3 | 68.4 | 42.6 | 68.1 | 71.5 | 69.6 | 70.7 |
| 7. P.trichocarpa_sc_44.102 | 26.8 | 27.2 | 38.6 | 25.6 | 27.4 | 27.4 | 27.2 | 27.1 | 47.2 | 25.6 | 27.7 | 27.1 | 26.3 |
| 8. O.sativa_Os05g46290 | 67.2 | 66.6 | 18.6 | 62.2 | 68.7 | 68.4 | 67.8 | 67.9 | 40.1 | 66.3 | 67.8 | 65.8 | 68.9 |
| 9. Z.mays_ZM07MC22894 | 65.8 | 65.3 | 17.2 | 62.2 | 68.4 | 67.5 | 67.0 | 68.0 | 38.4 | 65.7 | 67.6 | 65.4 | 67.6 |
| 10. S.lycopersicum_TC204816 | 70.1 | 72.5 | 18.8 | 66.3 | 73.2 | 71.8 | 70.5 | 70.0 | 44.1 | 69.5 | 72.2 | 70.3 | 70.0 |
| 11. A.thaliana_AT2G33210 | 83.4 | 84.1 | 21.7 | 75.7 | 83.2 | 82.8 | 82.4 | 81.2 | 49.2 | 80.9 | 85.0 | 83.6 | 82.4 |
| 12. A.thaliana_AT3G23990 | 87.2 | 89.1 | 22.3 | 79.5 | 87.9 | 85.9 | 85.8 | 84.6 | 51.7 | 84.4 | 89.4 | 87.7 | 85.8 |
| 13. L.esculentum_gl_39 |  | 88.4 | 22.1 | 76.5 | 84.6 | 83.1 | 83.2 | 83.1 | 50.6 | 81.5 | 85.1 | 83.4 | 84.5 |
| 14. S.lycopersicum_TC197855 | 95.0 |  | 22.5 | 78.8 | 87.3 | 85.8 | 85.3 | 84.2 | 51.7 | 84.0 | 87.6 | 85.2 | 85.6 |
| 15. A.cepa_CF435092 | 24.5 | 25.1 |  | 21.0 | 23.2 | 23.6 | 22.7 | 23.3 | 38.7 | 23.8 | 22.6 | 22.4 | 22.6 |
| 16. O.sativa_Os10g32550.1 | 85.3 | 85.8 | 22.7 |  | 90.4 | 86.6 | 85.9 | 83.0 | 47.3 | 77.3 | 79.8 | 77.2 | 78.1 |
| 17. O.sativa_glomalin_SEQID2 | 93.4 | 94.8 | 25.1 | 90.5 |  | 95.5 | 94.6 | 91.5 | 52.4 | 85.2 | 88.0 | 85.4 | 86.4 |
| 18. Z.mays_ZM07MC32795 | 92.9 | 93.9 | 25.3 | 88.5 | 97.4 |  | 93.1 | 90.3 | 51.4 | 85.2 | 88.0 | 85.1 | 85.8 |
| 19. O.sativa_Os03g04970.1 | 92.9 | 94.1 | 24.6 | 88.6 | 97.4 | 96.5 |  | 91.2 | 51.3 | 83.4 | 85.6 | 83.6 | 85.8 |
| 20. T.aestivum_c54647991 | 93.3 | 93.4 | 25.0 | 87.9 | 96.7 | 96.2 | 96.2 |  | 50.3 | 82.5 | 85.8 | 83.6 | 83.5 |
| 21. P.trichocarpa_sc_I.447 | 56.0 | 57.6 | 41.6 | 50.6 | 55.9 | 55.2 | 54.8 | 54.7 |  | 52.1 | 51.7 | 50.2 | 50.1 |
| 22. P.trichocarpa_sc_III.1436 | 90.3 | 92.1 | 25.6 | 82.0 | 90.6 | 90.5 | 89.4 | 89.2 | 56.0 |  | 85.9 | 83.0 | 82.6 |
| 23. M.truncatula_AC161864_24 | 94.5 | 95.8 | 24.7 | 86.6 | 95.6 | 94.4 | 93.8 | 93.9 | 57.1 | 92.2 |  | 94.8 | 88.2 |
| 24. M.truncatula_AC161864_3 | 94.0 | 94.6 | 24.7 | 86.0 | 94.6 | 93.9 | 93.9 | 93.4 | 56.6 | 91.1 | 98.1 |  | 86.3 |
| 25. P.trichocarpa_scaff_II.2576 | 93.3 | 94.3 | 25.0 | 84.9 | 93.6 | 92.5 | 93.1 | 92.2 | 55.5 | 89.6 | 95.1 | 94.4 |  |

Example 4

Identification of Domains Comprised in Polypeptide Sequences Useful in Performing the Methods of the Invention 4.1. eRF1 Polypeptides The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, ProDom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

The results of the InterPro scan of the polypeptide sequence as represented by SEQ ID NO: 2 are presented in Table C1.

TABLE C1

InterPro scan results (major accession numbers) of the polypeptide sequence as represented by SEQ ID NO: 2.

| Interpro ID | Domain name | Domain ID | Short Name | Location (amino acid coordinates) |
|---|---|---|---|---|
| IPR004403 | Peptide chain release factor eRF/aRF subunit 1 | PANTHER PTHR10113 | eRF1 | 1-436 |
| | | TIGRFAMs TIGR00108 | eRF1 | 4-422 |
| IPR005140 | eRF1 domain 1 | PFAM PF03463 | eRF1_1 | 6-140 |
| IPR005141 | eRF1 domain 2 | PFAM PF03464 | eRF1_2 | 144-278 |
| IPR005142 | eRF1 domain 3 | PFAM PF03465 | eRF1_3 | 281-418 |
| unintegrated | unintegrated | GENE3D G3DSA:3.30.1330.30 | — | 279-436 |
| | | GENE3D G3DSA:3.30.420.60 | — | 142-278 |
| | | GENE3D G3DSA:3.30.960.10 | — | 27-131 |
| | | PANTHER PTHR10113:SF1 | — | 1-436 |
| | | SUPERFAMILY SSF53137 | — | 142-277 |
| | | SUPERFAMILY SSF53135 | — | 278-423 |
| | | SUPERFAMILY SSF55481 | — | 4-141 |

4.2. SCAMP-Like Polypeptides

Pfam is a large collection of multiple sequence alignments and hidden Markov models covering many common protein domains and families. Pfam is hosted at the Sanger Institute server in the United Kingdom.

The results of the Pfam scan for conserved HMM PFam domains of the polypeptide sequence as represented by SEQ ID NO: 89 are presented in Table C2.

TABLE C2

InterPro scan results (major accession numbers) of the polypeptide sequence as represented by SEQ ID NO: 89.

| Database | Accession number | Amino acid coordinates on SEQ ID NO: 89 |
|---|---|---|
| Pfam | PF044144 | 91-265 |

4.3. Fibrillin Polypeptides

The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, ProDom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

The results of the InterPro scan of the polypeptide sequence as represented by SEQ ID NO: 205 are presented in Table C3.

TABLE C3

InterPro scan results (major accession numbers) of the polypeptide sequence as represented by SEQ ID NO: SEQ ID NO: 205.

| InterPRO accesssion | Database | Entry name |
|---|---|---|
| InterPro PAP Fibrillin Family IPR006843 | PFAM PF04755 | Pap fibrillin |
| No IPR integrated | SignalP | Signal Peptide |

4.4. PLATZ Polypeptides

The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, ProDom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

The results of the InterPro scan of the polypeptide sequence as represented by SEQ ID NO: 261 are presented in Table C4.

TABLE C4

InterPro scan results (major accession numbers) of the polypeptide sequence as represented by SEQ ID NO: 261.

| Database | Accession number | Accession name | Amino acid coordinates on SEQ ID NO 261 |
|---|---|---|---|
| HMMPfam | PF04640 | PLATZ | 21-131 (2e−67) |

4.5. PLST-Like Polypeptides

The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, ProDom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

The results of the InterPro scan of the polypeptide sequence as represented by SEQ ID NO: 411 are presented in Table C5.

TABLE C5

InterPro scan results (major accession numbers) of the polypeptide sequence as represented by SEQ ID NO: 411.

| Interpro ID | Domain ID | Domain ID | Short Name | Location (amino acid coordinates) |
|---|---|---|---|---|
| IPR003245 | PFAM PF02298 | Plastocyanin-like | Cu_bind_like | 38-124 |
| IPR008972 | GENE3D GSDA:2.60.40.420 | Cupredoxin | — | 25-134 |
| | SUPERFAMILY SSF49503 | Cupredoxins | Cupredoxins | 25-134 |
| Unintegrated | PRODOM PD003122 | Q6NLD7_ARATH_Q6NLD7; | | 60-130 |
| | SignalP | signal-peptide | signal-peptide | 1-27 |
| | TMHMM | Tmhmm | transmembrane_regions | 170-190 |

4.6. Glomalin Polypeptides

The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, ProDom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

The results of the InterPro scan of the polypeptide sequence as represented by SEQ ID NO: 546 are presented in Table C6.

TABLE C6

InterPro scan results (major accession numbers) of the polypeptide sequence as represented by SEQ ID NO: 546.

| Database | Accession number | Accession name | Amino acid coordinates on SEQ ID NO: 546 |
|---|---|---|---|
| InterPro | IPR001844 | Chaperonin Cpn60 | |
| PRINTS | PR00298 | CHAPERONIN60 | 1.7E-71 [118-144]T |
| | | | 1.7E-71 [174-201]T |
| | | | 1.7E-71 [359-382]T |
| | | | 1.7E-71 [441-466]T |
| | | | 1.7E-71 [489-510]T |
| TIGRFAMs | TIGR02348 | GroEL | 0.0 [94-619]T |
| InterPro | IPR002423 | Chaperonin Cpn60/TCP-1 | |
| PANTHER | PTHR11353 | Cpn60/TCP-1 | 0.0 [77-633]T |
| PFAM | PF00118 | Cpn60_TCP1 | 0.0 [114-617]T |
| SUPERFAMILY | SSF48592 | GroEL-ATPase | 1.4E-74 [101-614]T |
| InterPro | IPR018370 | Chaperonin Cpn60, conserved site | |
| PROSITE | PS00296 | CHAPERONINS_CPN60 | 0.0 [496-507]T |
| noIPR | unintegrated | | |
| GENE3D | G3DSA:1.10.560.10 | G3DSA:1.10.560.10 | 6.0E-33 [483-617]T |
| GENE3D | G3DSA:3.50.7.10 | G3DSA:3.50.7.10 | 3.4E-83 [265-467]T |
| PANTHER | PTHR11353:SF9 | PTHR11353:SF9 | 0.0 [77-633]T |
| | | | 0.0 [77-633]T |
| SUPERFAMILY | SSF52029 | SSF52029 | 4.3E-62 [275-467]T |
| SUPERFAMILY | SSF54849 | SSF54849 | 3.3E-19 [228-289]T |

In addition, SEQ ID NO: 546 has 3 N-glycosylation sites (Prosite PS00001): 110-NATN-113 113-NDTA-116, and 432-NATK-435.

Example 5

Topology Prediction of the Polypeptide Sequences Useful in Performing the Methods of the Invention 5.1. eRF1 Polypeptides TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal presequence a potential cleavage site can also be predicted.

A number of parameters are selected, such as organism group (non-plant or plant), cutoff sets (none, predefined set of cutoffs, or user-specified set of cutoffs), and the calculation of prediction of cleavage sites (yes or no).

Many other algorithms can be used to perform such analyses, including:
- ChloroP 1.1 hosted on the server of the Technical University of Denmark;
- Protein Prowler Subcellular Localisation Predictor version 1.2 hosted on the server of the Institute for Molecular Bioscience, University of Queensland, Brisbane, Australia;
- PENCE Proteome Analyst PA-GOSUB 2.5 hosted on the server of the University of Alberta, Edmonton, Alberta, Canada;
- TMHMM, hosted on the server of the Technical University of Denmark
- PSORT (URL: psort.org)
- PLOC (Park and Kanehisa, Bioinformatics, 19, 1656-1663, 2003).

5.2. SCAMP-Like Polypeptides

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal presequence a potential cleavage site can also be predicted.

Many other algorithms can be used to perform such analyses, including:
- ChloroP 1.1 hosted on the server of the Technical University of Denmark;
- Protein Prowler Subcellular Localisation Predictor version 1.2 hosted on the server of the Institute for Molecular Bioscience, University of Queensland, Brisbane, Australia;
- PENCE Proteome Analyst PA-GOSUB 2.5 hosted on the server of the University of Alberta, Edmonton, Alberta, Canada;
- TMHMM, hosted on the server of the Technical University of Denmark
- PSORT (URL: psort.org)
- PLOC (Park and Kanehisa, Bioinformatics, 19, 1656-1663, 2003).

5.3. Fibrillin Polypeptides

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site can also be predicted.

A number of parameters are selected, such as organism group (non-plant or plant), cutoff sets (none, predefined set of cutoffs, or user-specified set of cutoffs), and the calculation of prediction of cleavage sites (yes or no).

Many other algorithms can be used to perform such analyses, including:
- ChloroP 1.1 hosted on the server of the Technical University of Denmark;
- Protein Prowler Subcellular Localisation Predictor version 1.2 hosted on the server of the Institute for Molecular Bioscience, University of Queensland, Brisbane, Australia;
- PENCE Proteome Analyst PA-GOSUB 2.5 hosted on the server of the University of Alberta, Edmonton, Alberta, Canada;
- TMHMM, hosted on the server of the Technical University of Denmark
- PSORT (URL: psort.org)
- PLOC (Park and Kanehisa, Bioinformatics, 19, 1656-1663, 2003).

5.4. PLATZ Polypeptides

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal presequence a potential cleavage site can also be predicted.

A number of parameters were selected, such as organism group (non-plant or plant), cutoff sets (none, predefined set of cutoffs, or user-specified set of cutoffs), and the calculation of prediction of cleavage sites (yes or no).

The results of TargetP 1.1 analysis of the polypeptide sequence as represented by SEQ ID NO: 261 are presented Table D1. The "plant" organism group has been selected, no cutoffs defined, and the predicted length of the transit peptide requested. The subcellular localization of the polypeptide sequence as represented by SEQ ID NO: 261 may be the cytoplasm or nucleus, no transit peptide is predicted.

TABLE D1

TargetP 1.1 analysis of the polypeptide sequence as represented by SEQ ID NO: 261.

| Name | Len | cTP | mTP | SP | other | Loc | RC | TPlen |
|---|---|---|---|---|---|---|---|---|
| Pt583639 | 243 | 0.052 | 0.241 | 0.110 | 0.740 | — | 3 | — |
| cutoff | | 0.000 | 0.000 | 0.000 | 0.000 | | | |

Abbreviations: Len, Length; cTP, Chloroplastic transit peptide; mTP, Mitochondrial transit peptide, SP, Secretory pathway signal peptide, other, Other subcellular targeting, Loc, Predicted Location; RC, Reliability class; TPlen, Predicted transit peptide length.

Many other algorithms can be used to perform such analyses, including:
 ChloroP 1.1 hosted on the server of the Technical University of Denmark;
 Protein Prowler Subcellular Localisation Predictor version 1.2 hosted on the server of the Institute for Molecular Bioscience, University of Queensland, Brisbane, Australia;
 PENCE Proteome Analyst PA-GOSUB 2.5 hosted on the server of the University of Alberta, Edmonton, Alberta, Canada;
 TMHMM, hosted on the server of the Technical University of Denmark
 PSORT (URL: psort.org)
 PLOC (Park and Kanehisa, Bioinformatics, 19, 1656-1663, 2003).

5.5. PLST-Like Polypeptides

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal presequence a potential cleavage site can also be predicted.

Targetp v1.1 prediction results

| Name | Len | cTP | mTP | SP | other | Loc | RC | TPlen |
|---|---|---|---|---|---|---|---|---|
| Sequence | 191 | 0.001 | 0.483 | 0.951 | 0.006 | S | 3 | 27 |
| cutoff | | 0.620 | 0.760 | 0.000 | 0.530 | | | |

Number of query sequences: 1
Cleavage site predictions included.
Using PLANT networks.

A number of parameters are selected, such as organism group (non-plant or plant), cutoff sets (none, predefined set of cutoffs, or user-specified set of cutoffs), and the calculation of prediction of cleavage sites (yes or no).

Many other algorithms can be used to perform such analyses, including:
 ChloroP 1.1 hosted on the server of the Technical University of Denmark;
 Protein Prowler Subcellular Localisation Predictor version 1.2 hosted on the server of the Institute for Molecular Bioscience, University of Queensland, Brisbane, Australia;
 PENCE Proteome Analyst PA-GOSUB 2.5 hosted on the server of the University of Alberta, Edmonton, Alberta, Canada;
 TMHMM, hosted on the server of the Technical University of Denmark
 PSORT (URL: psort.org)
 PLOC (Park and Kanehisa, Bioinformatics, 19, 1656-1663, 2003).

5.6. Glomalin Polypeptides

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal presequence a potential cleavage site can also be predicted.

A number of parameters were selected, such as organism group (non-plant or plant), cutoff sets (none, predefined set of cutoffs, or user-specified set of cutoffs), and the calculation of prediction of cleavage sites (yes or no).

The results of TargetP 1.1 analysis of the polypeptide sequence as represented by SEQ ID NO: 546 are presented Table D2. The "plant" organism group has been selected, no cutoffs defined, and the predicted length of the transit peptide requested. The subcellular localization of the polypeptide sequence as represented by SEQ ID NO: 546 is most likely the mitochondrion (which is in agreement with results from PSORT), but possibly also the chloroplast.

TABLE D2

TargetP 1.1 analysis of the polypeptide sequence as represented by SEQ ID NO: 546.

| Name | Len | cTP | mTP | SP | other | Loc | RC | TPlen |
|---|---|---|---|---|---|---|---|---|
| SEQ ID NO: 546 | 574 | 0.379 | 0.856 | 0.011 | 0.013 | M | 3 | 32 |
| cutoff | | 0.000 | 0.000 | 0.000 | 0.000 | | | |

Abbreviations: Len, Length; cTP, Chloroplastic transit peptide; mTP, Mitochondrial transit peptide, SP, Secretory pathway signal peptide, other, Other subcellular targeting, Loc, Predicted Location; RC, Reliability class; TPlen, Predicted transit peptide length.

Many other algorithms can be used to perform such analyses, including:
 ChloroP 1.1 hosted on the server of the Technical University of Denmark;
 Protein Prowler Subcellular Localisation Predictor version 1.2 hosted on the server of the Institute for Molecular Bioscience, University of Queensland, Brisbane, Australia;

PENCE Proteome Analyst PA-GOSUB 2.5 hosted on the server of the University of Alberta, Edmonton, Alberta, Canada;
TMHMM, hosted on the server of the Technical University of Denmark
PSORT (URL: psort.org)
PLOC (Park and Kanehisa, Bioinformatics, 19, 1656-1663, 2003).

Example 6

Assay Related to the Polypeptide Sequences Useful in Performing the Methods of the Invention 6.1. PLATZ Polypeptides An assay for DNA binding by PLATZ proteins is described in Nagano et al. (2001). Briefly, a standard electrophoretic mobility shift assay (EMSA) is performed using a [$\gamma$-$^{32}$P]ATP labelled probe derived from the −734 to −667 region downstream of the pea pra2 transcriptional start site in binding buffer (20 μl) containing 2 μg of poly(dI-dC)-poly(dI-dC), bovine serum albumin (500 μg/μl), and competitor DNA. Using recombinantly produced and subsequently purified PLATZ protein, the protein-DNA complex is formed by incubating this mixture at 25° C. for 20 min with the $^{32}$P-labeled probe. Electrophoresis is conducted at 4° C. in a 5% polyacrylamide Tris-borate/EDTA gel. After drying, the gel is subjected to autoradiography. The requirement of zinc ions for the binding of the PLATZ protein to DNA can be tested by addition of 1,10-o-phenanthroline at concentrations from 0 to 5 mM.

Example 7

Cloning of the Nucleic Acid Sequence Used in the Methods of the Invention 7.1. eRF1 Polypeptides The nucleic acid sequence used in the methods of the invention was amplified by PCR using as template a custom-made *Oryza sativa* seedlings cDNA library (in pCMV Sport 6.0; Invitrogen, Paisley, UK). PCR was performed using Hifi Taq DNA polymerase in standard conditions, using 200 ng of template in a 50 μl PCR mix.

The primers used were: prm 09556 (fw) (SEQ ID NO: 86; sense, start codon in bold): 5'-gg ggacaagtttgtacaaaaaagca-ggcttaaacaatgggagacaaaaacgatgac-3' and prm 09557 (rev) (SEQ ID NO: 87; reverse, complementary): 5'-ggggaccacttt-gtacaagaaagctgggttttgattgattgtca ttccga-3', which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", peRF1. Plasmid pDONR201 was purchased from Invitrogen, as part of the Gateway® technology.

The entry clone comprising SEQ ID NO: 1 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 85) for constitutive specific expression was located upstream of this Gateway cassette.

Figure 2:
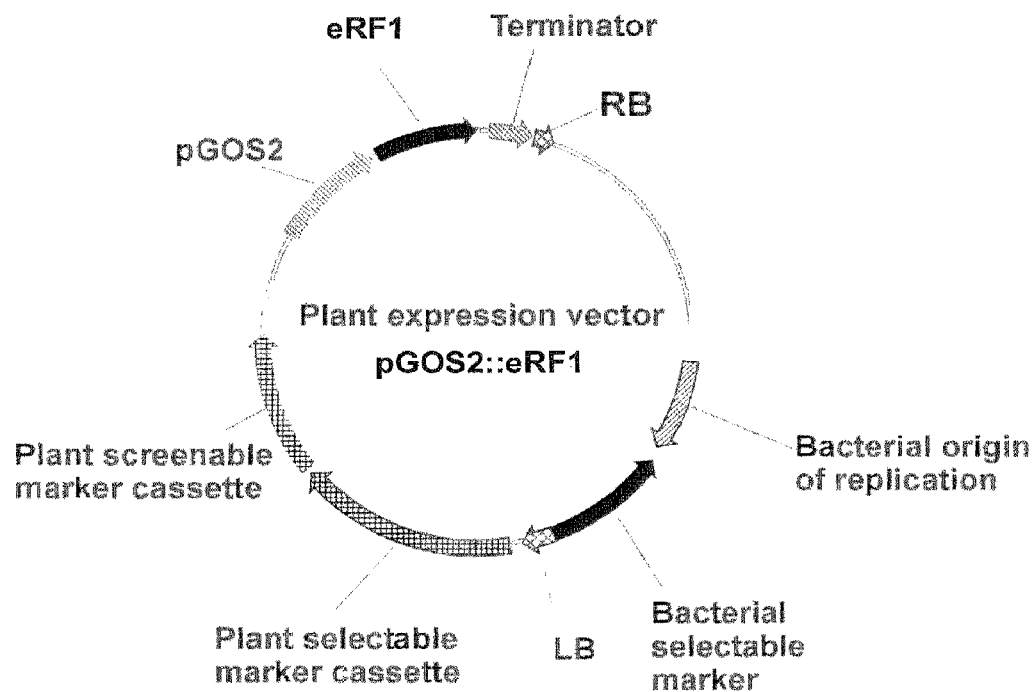
FIG. 2 represents the binary vector used for increased expression in *Oryza sativa* of an eRF1-encoding nucleic acid under the control of a rice GOS2 promoter (pGOS2).

After the LR recombination step, the resulting expression vector pGOS2::eRF1 (FIG. 2) was transformed into *Agrobacterium* strain LBA4044 according to methods well known in the art.

7.2. SCAMP-Like Polypeptides

The nucleic acid sequence used in the methods of the invention was amplified by PCR using as template a custom-made *Arabidopsis thaliana* seedlings cDNA library (in pCMV Sport 6.0; Invitrogen, Paisley, UK). PCR was performed using Hifi Taq DNA polymerase in standard conditions, using 200 ng of template in a 50 μl PCR mix. The primers used were prm 13820 (SEQ ID NO: 657; sense): 5'-ggggacaagtttgtacaaaaaagcaggcttaaacaatggcacg acacgatc-cta-3' and prm 13821 (SEQ ID NO: 658: reverse, complementary) 5'-ggggaccactttgtacaagaaagctgggttgatttcttcatagtg-cacgc-3', which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pSCAMP. Plasmid pDONR201 was purchased from Invitrogen, as part of the Gateway® technology.

The entry clone comprising SEQ ID NO: 88 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 203) for constitutive specific expression was located upstream of this Gateway cassette.

After the LR recombination step, the resulting expression vector pGOS2::SCAMP-LIKE (FIG. 4) was transformed into *Agrobacterium* strain LBA4044 according to methods well known in the art.

A further nucleic acid sequence used in the methods of the invention was amplified by PCR using as template a custom-made *Arabidopsis thaliana* seedlings cDNA library. PCR was performed using Hifi Taq DNA polymerase in standard conditions, using 200 ng of template in a 50 μl PCR mix. The primers used were prm 13818 (SEQ ID NO: 659; sense): 5'-ggggacaagtttgtacaaaaaagcaggcttaaacaatgaatgccaccac-gat-3' and prm 13819 (SEQ ID NO: 660: reverse, complementary) 5'-ggggaccactttgtacaagaaagctgggttctccttttcactt-gtttccc-3', which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pSCAMP. Plasmid pDONR201 was purchased from Invitrogen, as part of the Gateway® technology.

The entry clone comprising SEQ ID NO: 663 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 203) for constitutive specific expression was located upstream of this Gateway cassette.

After the LR recombination step, the resulting expression vector pGOS2::SCAMP-LIKEx was transformed into *Agrobacterium* strain LBA4044 according to methods well known in the art.

Another further nucleic acid sequence used in the methods of the invention was amplified by PCR using as template a custom-made *Arabidopsis thaliana* seedlings cDNA library. PCR was performed using Hifi Taq DNA polymerase in standard conditions, using 200 ng of template in a 50 µl PCR mix. The primers used were prm 13816 (SEQ ID NO: 661; sense): 5'-ggggacaagtttgtacaaaaaagcaggcttaaacaatg-gctaatcgttatgatcca-3' and prm 13817 (SEQ ID NO: 662; reverse, complementary) 5'-ggggaccactttgtacaagaaagctgggt-caaggagaactctca aacagc-3', which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pSCAMP. Plasmid pDONR201 was purchased from Invitrogen, as part of the Gateway® technology.

The entry clone comprising SEQ ID NO: 665 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 203) for constitutive specific expression was located upstream of this Gateway cassette.

After the LR recombination step, the resulting expression vector pGOS2::SCAMP-LIKEy was transformed into *Agrobacterium* strain LBA4044 according to methods well known in the art.

7.3. Fibrillin Polypeptides

The nucleic acid sequence used in the methods of the invention was amplified by PCR using a Lycopersicon esculentum (*Solanum lycopersicum*) cDNA library. PCR was performed using Hifi Taq DNA polymerase in standard conditions, using 200 ng of template in a 50 µl PCR mix. The primers used were prm10420 (SEQ ID NO: 258; sense, start codon in bold): 5'-ggggacaagtttgtacaaaaaagcaggcttaaacaat-gatttcagcaggtttcg-3' and prm10421 (SEQ ID NO: 259; reverse, complementary): 5'-ggggaccactttgta-caagaaagctgggtggctggttag caaataagagt-3', which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pfibrillin. Plasmid pDONR201 was purchased from Invitrogen, as part of the Gateway® technology.

The entry clone comprising SEQ ID NO: 204 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 257) for constitutive specific expression was located upstream of this Gateway cassette.

After the LR recombination step, the resulting expression vector pGOS2::fibrillin (FIG. 9) was transformed into *Agrobacterium* strain LBA4044 according to methods well known in the art.

7.4. PLATZ Polypeptides

Example A

In this example, a nucleic acid sequence for use in the methods of the invention was amplified by PCR using as template a custom-made *Populus* sp. seedlings cDNA library (in pCMV Sport 6.0; Invitrogen, Paisley, UK). PCR was performed using Hifi Taq DNA polymerase in standard conditions, using 200 ng of template in a 50 µl PCR mix. The primers used were prm13426 (SEQ ID NO: 274; sense, start codon in bold): 5'-ggggacaagtttgtacaaaaaagcaggct-taaacaatgggaactcaaaagcctgcat-3' and prm13427 (SEQ ID NO: 275; reverse, complementary): 5'-ggggaccactttgta-caagaaagctgggttttttcctaacataaagg agatcgatga-3', which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pPLATZ. Plasmid pDONR201 was purchased from Invitrogen, as part of the Gateway® technology.

The entry clone comprising SEQ ID NO: 260 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 273) for constitutive expression was located upstream of this Gateway cassette.

After the LR recombination step, the resulting expression vector pGOS2::PLATZ (FIG. 13) was transformed into *Agrobacterium* strain LBA4044 according to methods well known in the art.

Example B

In another example another nucleic acid sequence was amplified by PCR using as template a custom-made *Arabidospis* seedlings cDNA library. PCR was performed using Hifi Taq DNA polymerase in standard conditions, using 200 ng of template in a 50 µl PCR mix. The primers used were prm17901: (SEQ ID NO: 613; sense): 5'-ggggacaagtttgta-caaaaaagca ggcttaaacaatggttagagaaggtgaagaa-3', and prm17902 (SEQ ID NO: 614; reverse, complementary): 5'-ggggaccactttgtacaagaaagctgggttatgattttttgcctatggtta-3', which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce another "entry clone", pPLATZAt, according to the Gateway terminology. Plasmid pDONR201 was purchased from Invitrogen, as part of the Gateway® technology.

The entry clone comprising SEQ ID NO: 356 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 273) for constitutive expression was located upstream of this Gateway cassette.

After the LR recombination step, the resulting expression vector pGOS2::PLATZAt was transformed into *Agrobacterium* strain LBA4044 according to methods well known in the art.

7.5. PLST-Like Polypeptides

The nucleic acid sequence used in the methods of the invention was amplified by PCR using as template a custom-made *Populus* sp. seedlings cDNA library (in pCMV Sport 6.0; Invitrogen, Paisley, UK). PCR was performed using Hifi Taq DNA polymerase in standard conditions, using 200 ng of template in a 50 µl PCR mix.

The primers used were: prm13192 (fw) (SEQ ID NO: 543; sense, start codon in bold): 5'-ggggacaagtttgtacaaaaa agcaggcttaaacaatggtcaatcttagaagtcct-3' and prm13193 (rev) (SEQ ID NO: 544; reverse, complementary): 5'-ggggac-cactttgtacaagaaagctgggtctcatctgggttcttg taata-3' which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pPLST-like. Plasmid pDONR201 was purchased from Invitrogen, as part of the Gateway® technology.

The entry clone comprising SEQ ID NO: 410 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 542) for constitutive specific expression was located upstream of this Gateway cassette.

After the LR recombination step, the resulting expression vector pGOS2::PLST-like (FIG. 2) was transformed into *Agrobacterium* strain LBA4044 according to methods well known in the art.

7.6. Glomalin Polypeptides

The nucleic acid sequence was amplified by PCR using as template a custom-made *Oryza sativa* seedlings cDNA library (in pCMV Sport 6.0; Invitrogen, Paisley, UK). PCR was performed using Hifi Taq DNA polymerase in standard conditions, using 200 ng of template in a 50 µl PCR mix. The primers used were prm13455 (SEQ ID NO: 609; sense, start codon in bold): 5'-ggggacaagtttgtacaaaaaagcaggcttaaacaatg-taccgcgcggc-3' and prm13456 (SEQ ID NO: 610; reverse, complementary): 5'-ggggaccactttgtacaagaaagctgggtttag-taatccattccac ccat-3', which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pGlomalin. Plasmid pDONR201 was purchased from Invitrogen, as part of the Gateway® technology.

The entry clone comprising SEQ ID NO: 545 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice RCc3 promoter (SEQ ID NO: 611) for root specific expression was located upstream of this Gateway cassette.

After the LR recombination step, the resulting expression vector pRCc3::Glomalin (FIG. 19) was transformed into *Agrobacterium* strain LBA4044 according to methods well known in the art.

Example 8

Plant Transformation

Rice Transformation

The *Agrobacterium* containing the expression vector was used to transform *Oryza sativa* plants. Mature dry seeds of the rice japonica cultivar Nipponbare were dehusked. Sterilization was carried out by incubating for one minute in 70% ethanol, followed by 30 minutes in 0.2% HgC12, followed by a 6 times 15 minutes wash with sterile distilled water. The sterile seeds were then germinated on a medium containing 2,4-D (callus induction medium). After incubation in the dark for four weeks, embryogenic, scutellum-derived calli were excised and propagated on the same medium. After two weeks, the calli were multiplied or propagated by subculture on the same medium for another 2 weeks. Embryogenic callus pieces were sub-cultured on fresh medium 3 days before co-cultivation (to boost cell division activity).

*Agrobacterium* strain LBA4404 containing the expression vector was used for co-cultivation. *Agrobacterium* was inoculated on AB medium with the appropriate antibiotics and cultured for 3 days at 28° C. The bacteria were then collected and suspended in liquid co-cultivation medium to a density ($OD_{600}$) of about 1. The suspension was then transferred to a Petri dish and the calli immersed in the suspension for 15 minutes. The callus tissues were then blotted dry on a filter paper and transferred to solidified, co-cultivation medium and incubated for 3 days in the dark at 25° C. Co-cultivated calli were grown on 2,4-D-containing medium for 4 weeks in the dark at 28° C. in the presence of a selection agent. During this period, rapidly growing resistant callus islands developed. After transfer of this material to a regeneration medium and incubation in the light, the embryogenic potential was released and shoots developed in the next four to five weeks. Shoots were excised from the calli and incubated for 2 to 3 weeks on an auxin-containing medium from which they were transferred to soil. Hardened shoots were grown under high humidity and short days in a greenhouse.

Approximately 35 independent T0 rice transformants were generated for one construct. The primary transformants were transferred from a tissue culture chamber to a greenhouse. After a quantitative PCR analysis to verify copy number of the T-DNA insert, only single copy transgenic plants that exhibit tolerance to the selection agent were kept for harvest of T1 seed. Seeds were then harvested three to five months after transplanting. The method yielded single locus transformants at a rate of over 50% (Aldemita and Hodges 1996, Chan et al. 1993, Hiei et al. 1994).

Example 9

Transformation of Other Crops

Corn Transformation

Transformation of maize (*Zea mays*) is performed with a modification of the method described by Ishida et al. (1996) Nature Biotech 14(6): 745-50. Transformation is genotype-dependent in corn and only specific genotypes are amenable to transformation and regeneration. The inbred line A188 (University of Minnesota) or hybrids with A188 as a parent are good sources of donor material for transformation, but other genotypes can be used successfully as well. Ears are harvested from corn plant approximately 11 days after pollination (DAP) when the length of the immature embryo is about 1 to 1.2 mm. Immature embryos are cocultivated with *Agrobacterium tumefaciens* containing the expression vector, and transgenic plants are recovered through organogenesis. Excised embryos are grown on callus induction medium, then maize regeneration medium, containing the selection agent (for example imidazolinone but various selection markers can be used). The Petri plates are incubated in the light at 25° C. for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Wheat Transformation

Transformation of wheat is performed with the method described by Ishida et al. (1996) Nature Biotech 14(6): 745-50. The cultivar Bobwhite (available from CIMMYT, Mexico) is commonly used in transformation. Immature embryos are co-cultivated with *Agrobacterium tumefaciens* containing the expression vector, and transgenic plants are recovered through organogenesis. After incubation with *Agrobacterium*, the embryos are grown in vitro on callus induction medium, then regeneration medium, containing the selection agent (for example imidazolinone but various selection markers can be used). The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Soybean Transformation

Soybean is transformed according to a modification of the method described in the Texas A&M patent U.S. Pat. No. 5,164,310. Several commercial soybean varieties are amenable to transformation by this method. The cultivar Jack (available from the Illinois Seed foundation) is commonly used for transformation. Soybean seeds are sterilised for in vitro sowing. The hypocotyl, the radicle and one cotyledon are excised from seven-day old young seedlings. The epicotyl and the remaining cotyledon are further grown to develop axillary nodes. These axillary nodes are excised and incubated with *Agrobacterium tumefaciens* containing the expression vector. After the cocultivation treatment, the explants are washed and transferred to selection media. Regenerated shoots are excised and placed on a shoot elongation medium. Shoots no longer than 1 cm are placed on rooting medium until roots develop. The rooted shoots are transplanted to soil in the greenhouse. T1 seeds are produced from plants that exhibit tolerance to the selection agent and that contain a single copy of the T-DNA insert.

Rapeseed/Canola Transformation

Cotyledonary petioles and hypocotyls of 5-6 day old young seedling are used as explants for tissue culture and transformed according to Babic et al. (1998, Plant Cell Rep 17: 183-188). The commercial cultivar Westar (Agriculture Canada) is the standard variety used for transformation, but other varieties can also be used. Canola seeds are surface-sterilized for in vitro sowing. The cotyledon petiole explants with the cotyledon attached are excised from the in vitro seedlings, and inoculated with *Agrobacterium* (containing the expression vector) by dipping the cut end of the petiole explant into the bacterial suspension. The explants are then cultured for 2 days on MSBAP-3 medium containing 3 mg/l BAP, 3% sucrose, 0.7 Phytagar at 23° C., 16 hr light. After two days of co-cultivation with *Agrobacterium*, the petiole explants are transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots are 5-10 mm in length, they are cut and transferred to shoot elongation medium (MSBAP-0.5, containing 0.5 mg/l BAP). Shoots of about 2 cm in length are transferred to the rooting medium (MS0) for root induction. The rooted shoots are transplanted to soil in the greenhouse. T1 seeds are produced from plants that exhibit tolerance to the selection agent and that contain a single copy of the T-DNA insert.

Alfalfa Transformation

A regenerating clone of alfalfa (Medicago sativa) is transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown DCW and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659). Petiole explants are cocultivated with an overnight culture of *Agrobacterium tumefaciens* C58C1 pMP90 (McKersie et al., 1999 Plant Physiol 119: 839-847) or LBA4404 containing the expression vector. The explants are cocultivated for 3 d in the dark on SH induction medium containing 288 mg/L Pro, 53 mg/L thioproline, 4.35 g/L K2SO4, and 100 μm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings were transplanted into pots and grown in a greenhouse. T1 seeds are produced from plants that exhibit tolerance to the selection agent and that contain a single copy of the T-DNA insert.

Cotton Transformation

Cotton is transformed using *Agrobacterium tumefaciens* according to the method described in U.S. Pat. No. 5,159,135. Cotton seeds are surface sterilised in 3% sodium hypochlorite solution during 20 minutes and washed in distilled water with 500 μg/ml cefotaxime. The seeds are then transferred to SH-medium with 50 µg/ml benomyl for germination. Hypocotyls of 4 to 6 days old seedlings are removed, cut into 0.5 cm pieces and are placed on 0.8% agar. An *Agrobacterium* suspension (approx. 108 cells per ml, diluted from an overnight culture transformed with the gene of interest and suitable selection markers) is used for inoculation of the hypocotyl explants. After 3 days at room temperature and lighting, the tissues are transferred to a solid medium (1.6 g/l Gelrite) with Murashige and Skoog salts with B5 vitamins (Gamborg et al., Exp. Cell Res. 50:151-158 (1968)), 0.1 mg/l 2,4-D, 0.1 mg/l 6-furfurylaminopurine and 750 µg/ml MgCL2, and with 50 to 100 µg/ml cefotaxime and 400-500 µg/ml carbenicillin to kill residual bacteria. Individual cell lines are isolated after two to three months (with subcultures every four to six weeks) and are further cultivated on selective medium for tissue amplification (30° C., 16 hr photoperiod). Transformed tissues are subsequently further cultivated on non-selective medium during 2 to 3 months to give rise to somatic embryos. Healthy looking embryos of at least 4 mm length are transferred to tubes with SH medium in fine vermiculite, supplemented with 0.1 mg/l indole acetic acid, 6 furfurylaminopurine and gibberellic acid. The embryos are cultivated at 30° C. with a photoperiod of 16 hrs, and plantlets at the 2 to 3 leaf stage are transferred to pots with vermiculite and nutrients. The plants are hardened and subsequently moved to the greenhouse for further cultivation.

Example 10

Phenotypic Evaluation Procedure 10.1 Evaluation Setup

Approximately 35 independent T0 rice transformants were generated. The primary transformants were transferred from a tissue culture chamber to a greenhouse for growing and harvest of T1 seed. Six events, of which the T1 progeny segregated 3:1 for presence/absence of the transgene, were retained. For each of these events, approximately 10 T1 seedlings containing the transgene (hetero- and homo-zygotes) and approximately 10 T1 seedlings lacking the transgene (nullizygotes) were selected by monitoring visual marker expression. The transgenic plants and the corresponding nullizygotes were grown side-by-side at random positions. Greenhouse conditions were of shorts days (12 hours light), 28° C. in the light and 22° C. in the dark, and a relative humidity of 70%. Plants grown under non-stress conditions were watered at regular intervals to ensure that water and nutrients were not limiting and to satisfy plant needs to complete growth and development.

Four T1 events were further evaluated in the T2 generation following the same evaluation procedure as for the T1 generation but with more individuals per event. From the stage of sowing until the stage of maturity the plants were passed several times through a digital imaging cabinet. At each time point digital images (2048×1536 pixels, 16 million colours) were taken of each plant from at least 6 different angles.

Drought Screen

Plants from T2 seeds are grown in potting soil under normal conditions until they approached the heading stage. They are then transferred to a "dry" section where irrigation is withheld. Humidity probes are inserted in randomly chosen pots to monitor the soil water content (SWC). When SWC goes below certain thresholds, the plants are automatically re-watered continuously until a normal level is reached again. The plants are then re-transferred again to normal conditions. The rest of the cultivation (plant maturation, seed harvest) is the same as for plants not grown under abiotic stress conditions. Growth and yield parameters are recorded as detailed for growth under normal conditions.

Nitrogen Use Efficiency Screen

Rice plants from T2 seeds were grown in potting soil under normal conditions except for the nutrient solution. The pots were watered from transplantation to maturation with a specific nutrient solution containing reduced N nitrogen (N) content, usually between 7 to 8 times less. The rest of the cultivation (plant maturation, seed harvest) was the same as for plants not grown under abiotic stress. Growth and yield parameters were recorded as detailed for growth under normal conditions.

Salt Stress Screen

Plants are grown on a substrate made of coco fibers and argex (3 to 1 ratio). A normal nutrient solution is used during the first two weeks after transplanting the plantlets in the greenhouse. After the first two weeks, 25 mM of salt (NaCl) is added to the nutrient solution, until the plants are harvested. Seed-related parameters are then measured.

10.2 Statistical Analysis: F Test

A two factor ANOVA (analysis of variants) was used as a statistical model for the overall evaluation of plant phenotypic characteristics. An F test was carried out on all the parameters measured of all the plants of all the events transformed with the gene of the present invention. The F test was carried out to check for an effect of the gene over all the transformation events and to verify for an overall effect of the gene, also known as a global gene effect. The threshold for significance for a true global gene effect was set at a 5% probability level for the F test. A significant F test value points to a gene effect, meaning that it is not only the mere presence or position of the gene that is causing the differences in phenotype.

Where two experiments with overlapping events were carried out, a combined analysis was performed. This is useful to check consistency of the effects over the two experiments, and if this is the case, to accumulate evidence from both experiments in order to increase confidence in the conclusion. The method used was a mixed-model approach that takes into account the multilevel structure of the data (i.e. experiment-event-segregants). P values were obtained by comparing likelihood ratio test to chi square distributions.

10.3 Parameters Measured

Biomass-Related Parameter Measurement

From the stage of sowing until the stage of maturity the plants were passed several times through a digital imaging cabinet. At each time point digital images (2048×1536 pixels, 16 million colours) were taken of each plant from at least 6 different angles.

The plant aboveground area (or leafy biomass) was determined by counting the total number of pixels on the digital images from aboveground plant parts discriminated from the background. This value was averaged for the pictures taken on the same time point from the different angles and was converted to a physical surface value expressed in square mm by calibration. Experiments show that the aboveground plant area measured this way correlates with the biomass of plant parts above ground. The above ground area is the area measured at the time point at which the plant had reached its maximal leafy biomass. The early vigour is the plant (seedling) aboveground area three weeks post-germination. Increase in root biomass is expressed as an increase in total root biomass (measured as maximum biomass of roots observed during the lifespan of a plant); or as an increase in the root/shoot index (measured as the ratio between root mass and shoot mass in the period of active growth of root and shoot).

Root biomass can be determined using a method as described in WO 2006/029987.

Early vigour is a parameter related to development time of a plant. Early vigour was determined by counting the total number of pixels from aboveground plant parts discriminated from the background. This value was averaged for the pictures taken on the same time point from different angles and was converted to a physical surface value expressed in square mm by calibration. The results described below are for plants three weeks post-germination.

The "flowering time" of the plant can be determined using the method as described in WO 2007/093444.

Seed-Related Parameter Measurements

The mature primary panicles were harvested, counted, bagged, barcode-labelled and then dried for three days in an oven at 37° C. The panicles were then threshed and all the seeds were collected and counted. The filled husks were separated from the empty ones using an air-blowing device. The empty husks were discarded and the remaining fraction was counted again. The filled husks were weighed on an analytical balance. The number of filled seeds was determined by counting the number of filled husks that remained after the separation step. The total seed yield was measured by weighing all filled husks harvested from a plant. Total seed number per plant was measured by counting the number of husks harvested from a plant. Thousand Kernel Weight (TKW) is extrapolated from the number of filled seeds counted and their total weight. The Harvest Index (HI) in the present invention is defined as the ratio between the total seed yield and the above ground area (mm$^2$), multiplied by a factor 10$^6$. The total number of flowers per panicle as defined in the present invention is the ratio between the total number of seeds and the number of mature primary panicles. The seed fill rate as defined in the present invention is the proportion (expressed as a %) of the number of filled seeds over the total number of seeds (or florets).

Examples 11

Results of the Phenotypic Evaluation of the Transgenic Plants 11.1. eRF1 Polypeptides The results of the evaluation of transgenic rice plants in the T2 generation and expressing a nucleic acid comprising the longest Open Reading Frame in SEQ ID NO: 1 under non-stress conditions are presented below.

The results of the evaluation of transgenic rice plants under non-stress conditions are presented below (Table E1). An increase of (at least-more than) 5% was observed for aboveground biomass (AreaMax), seedling vigour (EmerVigor), yield per plant (totalwgseeds), total number of seeds per plant (nrtotalseed), number of panicles in the first flush (firstpan), number of filled seeds of a plant (nrfilledseed), harvest index, which is totalwgseeds/AreaMax (harvestindex).

TABLE E1

| Non-Stress conditions | |
|---|---|
| Parameter | Overall |
| AreaMax | 11.3 |
| EmerVigor | 20.0 |
| totalwgseeds | 14.6 |
| nrtotalseed | 12.2 |

TABLE E1-continued

| Non-Stress conditions | |
|---|---|
| Parameter | Overall |
| firstpan | 11.4 |
| nrfilledseed | 14.6 |

For each parameter, the percentage overall is shown if it reaches $p<0:05$ and above the 5% threshold.

11.2. SCAMP-Like Polypeptides

The results of the evaluation of transgenic rice plants in the T1 generation and expressing a nucleic acid comprising the longest Open Reading Frame in SEQ ID NO: 88 under the control of the rice GOS2 promoter and cultivated under the Nitrogen use efficiency screen conditions are presented below(Table E2A). See previous Examples for details on the generations of the transgenic plants.

An increase of (at least-more than) 5% was observed, as compared to control plants, for aboveground biomass (AreaMax), Rootbiomass (RootMax), emergence vigour (Emervigor, early vigour), total seed yield (totalwgseeds), number of filled seeds (nrfilledseed), fill rate, number of seeds per plant (nrtotalseeds), harvest index (harvestindex), and number of primary panicles (firstpan).

TABLE E2A

| yield-related trait | % increased in transgenic plant compared to control nullyzygous plant |
|---|---|
| Areamax | 21.5 |
| Emervigor | 10.9 |
| RootMax | 65.6 |
| totalwgseeds | 28.25 |
| nrtotalseeds | 26.4 |
| harvestindex | 30.7 |
| firstpan | 62.7 |
| nrfilledseed | 68.8 |

The results of the evaluation of transgenic rice plants in the T1 generation and expressing a nucleic acid comprising the longest Open Reading Frame in SEQ ID NO: 663 under the control of the rice GOS2 promoter and cultivated under the Nitrogen use efficiency screen conditions are presented below. See previous Examples for details on the generations of the transgenic plants.

An increase of at least 5% was observed, as compared to control plants, for Greeness before Flowering (GNbfFlow) for 3 lines, for Gravity Yield Max (GravityYMax) for 2 lines. Furthermore we observed an increase of at least 5% for fillrate, thousand kernel weight (TKW), number of filled seeds (nrfilledseed), flowers per panicle (flowerperpan) and maximum height of the plant, i.e. the highest tip of the plant, in at least one line.

The results of the evaluation of transgenic rice plants in the T1 generation and expressing a nucleic acid comprising the longest Open Reading Frame in SEQ ID NO: 665 under the control of the rice GOS2 promoter and cultivated under the nitrogen Nitrogen use efficiency screen conditions are presented below (Table E2B). See previous Examples for details on the generations of the transgenic plants.

An increase of (at least-more than) 5% was, observed as compared to control plants, for aboveground biomass (Rootbiomass (RootMax), total seed yield (totalwgseeds), harvest index (harvestindex), thousand kernel weight (TKW) and number of filled seeds (nrfilledseed).

TABLE E2B

| yield-related trait | % increased in transgenic plant compared to control nullyzygous plant |
| --- | --- |
| RootMax | 5.0 |
| totalwgseeds | 25.5 |
| harvestindex | 23.9 |
| TKW | 5.0 |
| nrfilledseed | 22.5 |

11.3. Fibrillin Polypeptides

Each parameter shown in the tables below gives a percentage overall difference with a p value of p<0.05. The results of the evaluation show an increase in the total seed weight, seed fill rate, harvest index and in the number of filled seeds compared to control plants (corresponding nullizygotes).

TABLE E3

T1 Generation

| Parameter | Overall |
| --- | --- |
| Total weight seeds | 17.9% |
| Fill rate | 9.6% |
| Harvest index | 10.5% |
| No. filled seeds | 15.1% |

TABLE E4

T2 Generation

| Parameter | Overall |
| --- | --- |
| Total weight seeds | 12.3% |
| Fill rate | 8.5% |
| Harvest index | 9.8% |
| No. filled seed | 9.8% |

11.4. PLATZ Polypeptides

Example A

The results of an evaluation of transgenic rice plants in the T1 generation expressing an PLATZ nucleic acid of SEQ ID NO: 260 (see point 7.4 above-example A) under non-stress conditions are presented hereunder. An increase was observed for above ground biomass (AreaMax) and root biomass (RootThickMax), total seed weight (totalwgseeds), harvest index, thousand-kernel weight (TKW) (Table E5A).

TABLE E5A

Data summary for transgenic rice plants; for each parameter, the overall percent increase as compared to control plants is shown, for each parameter the p-value is ≤0.05.

| Parameter | Overall increase |
| --- | --- |
| AreaMax | 12.6 |
| totalwgseeds | 19.8 |
| harvestindex | 7.6 |
| TKW | 17.9 |
| RootThickMax | 5.9 |

Example B

The results of an evaluation of transgenic rice plants in the T1 generation expressing a PLATZ nucleic acid of SEQ ID NO: 356 (see point 7.4 above-example B) under non-stress conditions are presented hereunder. An increase was observed for yield-related parameters such as an increased rate of filled seeds over the number of total seeds (fillrate) and an increased increased thousand-kernel weight (TKW). The transgenic plants also showed a quicker early development as compared to control plants (Table E5B). The latter parameter is indicated by AreaEmer in Table E5B and represents the Ratio in % between the time a plant needs to make 30% of the final biomass and the time the plant needs to make 90 of its final biomass.

TABLE E5B

Data summary for transgenic rice plants; for each parameter, the overall percent increase as compared to control plants is shown, for each parameter the p-value is ≤0.05.

| Parameter | Overall increase |
| --- | --- |
| Fillrate | 5.7% |
| TKW | 3.5% |
| AreaEmer | 5.3% |

In addition, plants expressing a PLATZ protein grown under conditions of abiotic stress such as drought stress, nutrient stress, salt stress, show improved yield-related traits, comprising one or more of increased biomass, such as above-ground or/and below-ground; increased seed yield as defined in the definitions section; early vigour.

11.5. PLST-Like Polypeptides

The results of the evaluation of transgenic rice plants in the T2 generation and expressing a nucleic acid comprising the longest Open Reading Frame in SEQ ID NO: 410 under non-stress conditions are presented below.

The results of the evaluation of transgenic rice plants expressing the PLST-like polypeptide represented by SEQ ID NO 411 under drought conditions are presented below (Table E6). An increase of more than 5% was observed for total seed weight (totalwgseeds), rate of filled seeds over the number of total seeds (fillrate), harvest index, which is totalwgseeds/AreaMax (harvestindex) and number of filled seeds (nrfilledseed).

TABLE E6

Data summary for transgenic rice plants grown under drought stress conditions; the overall increase is shown and for each parameter the p-value is ≤0.05.

| Parameter | Overall |
| --- | --- |
| totalwgseeds | 19.2 |
| fillrate | 27.2 |
| harvestindex | 21.6 |
| nrfilledseed | 17.1 |

11.6. Glomalin Polypeptides

Transgenic rice plants expressing the Glomalin gene under control of the root-specific RCc3 promoter had increased seed yield, in particular increased 1000 kernel weight (overall increase 2.8% with a p-value of 0.035). Three out of six lines also had increased harvest index.

SEQUENCE LISTING (674 sequences)

SEQ ID NO: 1 - DNA, 1305 bp, Arabidopsis thaliana
atggcagaagaagcggatacgaacatcgagatctggaagattaagaaactaatcaagggacttgaatcagctagaggtaatggaacgagtatgatctctcttattatgcctcctcgtgatcaagtatctcgtgtcacaaagatgcttggtgatgaatatggaactgcttcaaacattaagagtcgagtcaatcgtcaatctgttttgtctgccattacttctgctcaacaaaggttgaagctttacaacaaggttcctactaatggtcttgttctctataccggcaccattgttaatgatgacggtaaagagaagaaggtgacgtttgatttcgagccctttaggccgattaatgcttccttgtacctttgtgacaacaagttccatactgaggcattgaacgagcttcttgagtctgatgacaagtttggtttcattgttatggatggtaatgggacactgtttggaactttgagtgggaatactagagaggttcttcataagtttactgttgatctcccgaagaagcacggaagaggaggacagtctgcacttcgttttgcccgtcttaggatggagaagagacacaattatgttaggaaaaccgctgagcttgctacacagttttacatcaatccagctacgagtcagcctaatgtctctggtctgatccttgctggttcagctgatttcaaaactgagctcagtcaatcagagttgtttgatcctcgtcttcaagctaagatattgaatgttgttgatgtttcttacggaggtgaaaacggtttcaaccaagcgattgagctgtctgctgagattctatccaatgtgaagttcatacaggagaagaaactgattgggaagtactttgaggagataagtcaagataccgggaaatacgttttcggtgtggaggatactctaaaggctctagaaatgggtgctatcgaaacccttatcgtgtgggagaatctggacataaacaggtatgagctaaagaacagtacgacaggagaaatggtggtgaaacactttgggaaagatcaagagtctgatacaagcaacttccatgattcagagactaacgcggagctagaagtacaggagaagatgcctctactcgaatggtttgcaaatgagtacaaacgtttcggctgcactcttgagtttgtgactaacaaatcccaagaagggtcacagttttgcagaggttttggtgggattggtggtatgttacgttaccagcttgacatgaggacatttgatgagttatcagatactgaagtttacgaagattctgattaa

SEQ ID NO: 2 - protein, 434 aa, Arabidopsis thaliana
MAEEADTNIEIWKIKKLIKGLESARGNGTSMISLIMPPRDQVSRVTKMLGDEYGTASNIKSRVNRQSVLSAITSAQQRLKLYNKVPTNGLVLYTGTIVNDDGKEKKVTFDFEPFRPINASLYLCDNKFHTEALNELLESDDKFGFIVMDGNGTLFGTLSGNTREVLHKFTVDLPKKHGRGGQSALRFARLRMEKRHNYVRKTAELATQFYINPATSQPNVSGLILAGSADFKTELSQSELFDPRLQAKILNVVDVSYGGENGFNQAIELSAEILSNVKFIQEKKLIGKYFEEISQDTGKYVFGVEDTLKALEMGAIETLIVWENLDINRYELKNSTTGEMVVKHFGKDQESDTSNFHDSETNAELEVQEKMPLLEWFANEYKRFGCTLEFVTNKSQEGSQFCRGFGGIGGMLRYQLDMRTFDELSDTEVYEDSD

SEQ ID NO: 3 - DNA, 1308 bp, Arabidopsis thaliana
atggcagaccaagaatcagataagaacattgagatttggaagattaagaagctaatcaaaggacttgaaaccgcaagaggtaatggaacaagtatgatctctcttataatgcctcctagagatcaagtagctcgtgtcactaagatgcttgctgatgaatacggaaccgcctcaaacatcaagagtcgagtgaatcgtcaatctgttttatctgccattacttctgctcaacaaagattgaagctttacaacaaagttcctccgaatggtcttgttctctatactggaaccattgttactgatgatggtaaagagaagaaagtgacgattgatttcgagccttttaaaccgattaatgcttcgttgtatttgtgtgacaataagttccacaccgagcctttgaatgagcttttggagtctgatgataagtttggtttcattgttatggatggaaatggaactttgtttggtactttgagtgggaatacaagagaggttcttcataagttcactgtcgatcttccgaaaaagcacggaagaggaggacaatctgcgttgcgatttgctcgtcttaggatggagaagagacataactatgtgaggaaaaccgcggagcttgccactcagttttacattaatccagctacgagtcagcctaatgtctctggtcttatacttgctggttcagcggattttaagaccgagctaagtcaatcagaactgtttgatcctcgtcttcaagctaagatattgaatgtggttgatgtttcttacggaggagagaatggtttcaaccaagcaattgagctgtctgctgagattctatctaatgtgaagttcatacaagaaaagaaattgattgggaagtactttgaggagattagtcaagacactgggaaatatgttttcggtgttgaagatactttaaaggctctggaaatgggtgctgttgagactcttatagtgtgggagaatctagatattaataggtatgagttaaagaacaacacgaccggagaaatcgtgattaagcatttgggaaaggatcaagagaacaaccaaagcaatttccatgatgcagagactaatgcagagttagaagttcaggagaagatgcctctgcttgaatggtttgctaacgaatataaacgttttggttgtacacttgagtttgtgactaacaagtcccaagaaggatcacaattttgcagaggctttggcggtattggtggattgttgcggtaccagcttgatatgaggacattcgatgaattatccgatggtgaagtttatgaagactcagattaa

SEQ ID NO: 4 - protein, 435 aa, Arabidopsis thaliana
MADQESDKNIEIWKIKKLIKGLETARGNGTSMISLIMPPRDQVARVTKMLADEYGTASNIKSRVNRQSVLSAITSAQQRLKLYNKVPPNGLVLYTGTIVTDDGKEKKVTIDFEPFKPINASLYLCDNKFHTEPLNELLESDDKFGFIVMDGNGTLFGTLSGNTREVLHKFTVDLPKKHGRGGQSALRFARLRMEKRHNYVRKTAELATQFYINPATSQPNVSGLILAGSADFKTELSQSELFDPRLQAKILNVVDVSYGGENGFNQAIELSAEILSNVKFIQEKKLIGKYFEEISQDTGKYVFGVEDTLKALEMGAVETLIVWENLDINRYELKNNTTGEIVIKHLGKDQENNQSNFHDAETNAELEVQEKMPLLEWFANEYKRFGCTLEFVTNKSQEGSQFCRGFGGIGGLLRYQLDMRTFDELSDGEVYEDSD

SEQ ID NO: 5 - DNA, 1311 bp, Arabidopsis thaliana
atgggagacaaaaacgatgacgacaagaacattgagatatggaagattaagaagctgatcaaatcacttgaagctgctaggggtaatggaaccagcatgatctcactcatcatgcctccgcgtgatcaggtctctcgtgttaccaagatgttgggtgatgagtatggaaccgcgtcaaacatcaagagcagagtcaatcgtcaatctgttttgggggccataacttctgctcagcaaaggttgaaactttacaacagggtccctcctaatggtcttgtactctatactggaaccattgttaatgaggatggtaaggagaagaaggttactattgactttgagcctttcagacccatcaatgcttctctctacctttgtgacaacaagtttcacacggaagctttgaatgaattgttggagtctgatgacaagtttggtttcattgtaatggatggaaacgggactctctttggaactcttagtggtaacacccgtgaggtacttcacaagttctctgttgatcttccgaagaaacacggaagaggaggacagtctgctcttcgttttgcccgtctccgtatggagaagcgtcacaattatgttaggaagactgctgagctcgccacacagtactacatcaatcctgctacaagtcagcctaatgtgtctggactgattcttgctggttcagcagatttcaagactgagttgagtcagtctgatatgtttgatccccgactggctgcgaagatactgaatgtggtggatgtatcatatggaggagaaaatggttttaatcaagctattgagctgtcagctgaaatccttgcgaatgtgaagtttatccaagagaagcgtctgattgggaagtactttgaggagataagccaggacacggggaagtatgtgtttggtgtggaagatacgttgaacgctttggagtctggtgctattgagacactgattgtatgggaaaatctcgatatcaacagatatgtgatgaagaacagtgcgactggtgaaactgtgatcaaacacctgaacaaggaacaagaagccaacactgagaacttcaaagtagccgacagtgacttggctttggacgtggaggagaagctgtcgttactggagtggcttgccaatgagtacaggcgttttggttgtgcgttagagtttgtgaccaacaagtcacaggaaggttctcagttttgcagagggtttggaggaatcggaggaatacttcgttaccagcttgacatgactgcctttgattccgaggatggagaagctcttgatgatgattcggaatga

SEQ ID NO: 6 - protein, 436 aa, Arabidopsis thaliana
MGDKNDDDKNIEIWKIKKLIKSLEAARGNGTSMISLIMPPRDQVSRVTKMLGDEYGTASNIKSRVNRQSVLGAITSAQQRLKLYNRVPPNGLVLYTGTIVNEDGKEKKVTIDFEPFRPINASLYLCDNKFHTEALNELLESDDKFGFIVMDGNGTLFGTLSGNTREVLHKFSVDLPKKHGRGGQSALRFARLRMEKRHNYVRKTAELATQYYINPATSQPNVSGLILAGSADFKTELSQSDMFDPRLAAKILNVVDVSYGGENGFNQAIELSAEILANVKFIQEKRLIGKYFEEISQDTGKYVFGVEDTLNALESGAIETLIVWENLDINRYVMKNSATGETVIKHLNKEQEANTENFKVADSDLALDVEEKLSLLEWLANEYRRFGCALEFVTNKSQEGSQFCRGFGGIGGILRYQLDMTAFDSEDGEALDDDSE

SEQ ID NO: 7 - DNA, 1311 bp, Aquilegia sp.
atggctgatggtcaagaaacagacaagaatattgagatatggaagatcaagaaattgattaaggctctggaagctgccagaggcaatggtactagcatgatctctcttatcatgcctccacgtgatcaggtgtctcgggttgctaagatgttgggtgacgaatatggtactgcttccaatatcaagagtagggttaatcgacaatccgtgttgggggctattacttctgctcaacagaggcttaagctttataataaggttccgacaaatggtttggtgttatacactgggacaatagtgactgaagatgggaaggaaaagaaggtaacaattgactttgagccttttaaacccattaatgcttctctgtacctttgtgataacaagttccatacagaggctttgaatgaacttttggagtcagatgacaagtttggcttcattgttatggatggaaatggaaccctttttggaactttaagtggtaacacacgtgaagtccttcataagtttactgttgatctgcccaagaaacatggtagaggaggacagtcagctctgcgatttgctcggcttcggatggagaaacgccacaactatgttagaaagacagctgagcttgccacacagttttacatcaatcctgctactagccaaccgaatgttgcgggattaatccttgctgggtctgcagactttaagacagagttgagccagtcagatatgtttgatccccgccttggagccaagatactgaatgtggttgatgtttcatatggaggtgagaatggttttaatcaggctattgagctgtcttcagagatcctatccaatgtgaagtttgtccaggagaagcgtttgataggcaagtactttgaggaaattagtcaggatactgggaagtatgttttcggggtggacgacactctgaaggcactagaaatgggtgctgttgagactcttatcgtgtgggagaatctggatattaccaggtatgtactaaagaatactgcgacaagtgagcccataataaagcacctgaacaaagaacaggcagccaatgacagcaacttccgggatgctgaaacttcagttgaattggaggttcaggagaaagaattactgctagaatggtttgcgaacgagtacaagaagtttggttgcagtcttgagtttgttaccaatagatctcaagagggttcacagttttgcagagggtttggtggcatcggcggtatcctccgttaccagcttgatatgaggtcgtttgatgatctgtcagatgatgaagtttatgaagattctgaatag

SEQ ID NO: 8 - protein, 436 aa, Aquilegia sp.
MADGQETDKNIEIWKIKKLIKALEAARGNGTSMISLIMPPRDQVSRVAKMLGDEYGTASNIKSRVNRQSVLGAITSAQQRLKLYNKVPTNGLVLYTGTIVTEDGKEKKVTIDFEPFKPINASLYLCDNKFHTEALNELLESDDKFGFIVMDGNGTLFGTLSGNTREVLHKFTVDLPKKHGRGGQSALRFARLRMEKRHNYVRKTAELATQFYINPATSQPNVAGLILAGSADFKTELSQSDMFDPRLGAKILNVVDVSYGGENGFNQAIELSSEILSNVKFVQEKRLIGKYFEEISQDTGKYVFGVDDTLKALEMGAVETLIVWENLDITRYVLKNTATSEPIIKHLNKEQAANDSNFRDAETSVELEVQEKELLLEWFANEYKKFGCSLEFVTNRSQEGSQFCRGFGGIGGILRYQLDMRSFDDLSDDEVYEDSE

SEQ ID NO: 9 - DNA, 1314 bp, Citrus sinensis
atgtcagatggtcaggaaaccgataagaacatagagatatggaaaatcaaaaaattgatcaaggcactggaatctgcaagaggtaatggaaccagtatgatatcccttattatgcctccacgtgatcaaatttctcgggtcacaaagatgcttggtgatgaatttggaactgcttcaaacattaaaagtagggtcaaccgtcagtctgttctggctgctattacttctgctcagcagaggctgaagctatataacaaggttcctcccaatgggctggtgctttatactggaacagttgttactgaggatggcaaggaaaagaaagtgacaattgactttgaacctttcaagcctattaatgcatcgttgtatctctgtgataacaagtttcacactgaagccttgaatgaactcttagaatctgatgataaatttgggtttattgtcatggatggaaatggcaccctatttggcacattaagtggaaacacaagagaggtgcttcataagtttactgttgatctgccgaagaagcatggaagaggagggcagtcagctcttcgttttgctcgtcttcggatggagaaacggcacaactatgtgaggaagacagcagagcttgctacacagttctttatcaatcctgctaccagtcagcccaatgtgtctgggataattcttgctggttctgctgatttcaaaactgagctgagccagtctgatatgtttgatcctcgtttacaagccaagatattgaatgttgttgatgtttcttatggtggggaaaatggttttaaccaagcaattgagttgtctgcagaaatcttatcaaatgtgaagttcatacaagaaaaacgtttgattggaaaatactttgaggagattagtcaggacactggaaaatatgtgtttggtgttgatgacactttgaaggctctggaattgggtgctgtagaaatccttattgtgtgggaaaatctggatatcaatagatatgtactgaaaaacagtgctactggtgaaattgttataaagcacttaaacagagaccaagaggccaatcagagcaacttccgcgatgcagccacatctgctgagttggaggttcaggaaaagacatctttactcgagtggtttgccaatgagtacaaacagtttggttgtacgcttgagtttgttaccaacaaatcccaggagggctcacagttttgcagagggtttggtggaattggtggtatacttcgctaccagcttgacataagatcatatgatgagctatctgacgatggaggtgtttatgaggattctgattag

SEQ ID NO: 10 - protein, 437 aa, Citrus sinensis
MSDGQETDKNIEIWKIKKLIKALESARGNGTSMISLIMPPRDQISRVTKMLGDEFGTASNIKSRVNRQSVLAAITSAQQRLKLYNKVPPNGLVLYTGTVVTEDGKEKKVTIDFEPFKPINASLYLCDNKFHTEALNELLESDDKFGFIVMDGNGTLFGTLSGNTREVLHKFTVDLPKKHGRGGQSALRFARLRMEKRHNYVRKTAELATQFFINPATSQPNVSGIILAGSADFKTELSQSDMFDPRLQAKILNVVDVSYGGENGFNQAIELSAEILSNVKFIQEKRLIGKYFEEISQDTGKYVFGVDDTLKALELGAVEILIVWENLDINRYVLKNSATGEIVIKHLNRDQEANQSNFRDAATSAELEVQEKTSLLEWFANEYKQFGCTLEFVTNKSQEGSQFCRGFGGIGGILRYQLDIRSYDELSDDGGVYEDSD

SEQ ID NO: 11 - DNA, 1311 bp, Centaurea solstitialis
atgtcggacggtcaagaaactgataagaacatagagatatggaagattaagaagctaatcaaggcattggaagctgcaagaggcaatggtaccagcatgatttctcttattatgcctccacgggatcaaatttctcgagtcaccaagatgcttggcgatgaattcggaactgcttctaatattaagagcagggtgaatcgccagtctgttttaggtgctataacatctgcccagcagagactcaagctatacaacaaggtccctccaaatggactcgtgctttataccggaacgatagttacagatgatggaaaggagaaaaaggttacgattgactttgagcccttcaagccgattaatgcttccctatacctctgtgacaacaagtttcatacagaagctcttaatgagctgttggagtctgacgataagtttggttttattgttatggatggtaatgggacccttttcgggacattgagtggcaacacgagggaggtgctgcacaaattcacggttgatttgccgaagaagcacggacgaggagggcagtcagctctgcgttttgctcgtcttcgaatggaaaagcgtcacaattatgtgaggaagacagctgaacttgcaacacagttctatatcaatcctgccactagccagccgaacgtttctggacttatacttgctggatctgctgattttaagaccgagctgagccaatctgatatgtttgatcctcgtcttcaggctaaaatcttgaatgtggttgatgtttcctatggaggcgagaatgggttcaatcaggctattgaactgtcctctgaaatccttgccaatgtgaagtttatacaagaaaagcgtttgattggcaagtatttcgaggagattagtcaggataccggtaagtatgtgtttggtgttgatgacactttgaaagctttggagatgggtgctgttgaaattctcattgtgtgggaaaatctggacatcaatcggtatgtccttaaaaatagcactacaagtgaagttaccatagctcacttcaacaaggaccaggaggctgatcagagtaactttcgagactctgtcaccaatgctgagctggaagttcaggaaaagacgtcgttgctcgagtggtttgctaacgagtacaagaaatttggatgcacacttgagttcgtgacgaacaaatctcaagagggttcgcaattttgtaggggttttggtggaattggtgggatacttcgctaccagcttgacatccgatcatttgatgatctttctgatgacggggaaaattatgaatccgaatag

SEQ ID NO: 12 - protein, 436 aa, Centaurea solstitialis
MSDGQETDKNIEIWKIKKLIKALEAARGNGTSMISLIMPPRDQISRVTKMLGDEFGTASNIKSRVNRQSVLGAITSAQQRLKLYNKVPPNGLVLYTGTIVTDDGKEKKVTIDFEPFKPINASLYLCDNKFHTEALNELLESDDKFGFIVMDGNGTLFGTLSGNTREVLHKFTVDLPKKHGRGGQSALRFARLRMEKRHNYVRKTAELATQFYINPATSQPNVSGLILAGSADFKTELSQSDMFDPRLQAKILNVVDVSYGGENGFNQAIELSSEILANVKFIQEKRLIGKYFEEISQDTGKYVFGVDDTLKALEMGAVEILIVWENLDINRYVLKNSTTSEVTIAHFNKDQEADQSNFRDSVTNAELEVQEKTSLLEWFANEYKKFGCTLEFVTNKSQEGSQFCRGFGGIGGILRYQLDIRSFDDLSDDGENYESE

SEQ ID NO: 13 - DNA, 1314 bp, Glycine max
atggttgatggccatgagactgataagaacattgaggtgtggaaaatcaagaaattgatcaaagctcttgaggctgctagaggaaatgggacaagtatgatttcccttatcatgcctccacgtgatcaaatatctcgtgtcactaagatgcttggtgatgagtttggaactgcatcaaacatcaaaagcagggtgaatcgacagtcagttcttggtgcaatcacttctgctcagcagaggcttaaactctataacaaggttcctccaaatggtcttgttctgtatactggcacaattgtgactgatgatgggaaggaaaagaaggtgactattgattttgagcctttcagacctattaatgcatccctttatctttgtgacaataagtttcacactgaagctttgaatgagctccttgagtctgatgacaagtttggatttattgtcatggatggcaacggtactttgtttgggacattgagtggtaatacaagagaggtgcttcataaattcagtgtggatctcccaaagaaacatggaagaggagggcaatctgctctgcgttttgcccgtcttcgcatggagaagcgtcataactatgtgcggaagacggccgagcttgctacccagttctatatcaatcctgctaccagccaacccaatgtttctggattaatactggctggttcagctgatttcaagactgaacttagtcagtcagatatgtttgatcctcgacttcaggcaaaaatactcaatgttgttgatgtctcctacggaggcgagaatgggtttaatcaggctattgaactctctgctgaaattctgtccaatgtgaagtttatccaggagaagcgattgattggaaaatactttgaggaaatcagccaggatactgggaagtatgtttttggggttgatgatactctaaaggctttagagatgggagctgttgagacacttattgtgtgggaaaatctggatatgaataggtatgtcttgaaaaatagtgctactggtgaggttgtcattaagcacttaaacaaggaacaggatgccgatcaaagcaattttcgggatcctgagagcaatgctgattttgaggttcaggagaagttgtctctgctggagtggtttgcaaatgaatacaaacgcttcggttgcactcttgagtttgtcaccaataaatcacaagaaggctcacaattttgcagaggttttggtgggataggtgggatcttgcggtaccagctggatatgcgatcatttgatgatttctctgatgatggaggcgtgtacgatgattctgaatag

SEQ ID NO: 14 - protein, 437 aa, Glycine max
MVDGHETDKNIEVWKIKKLIKALEAARGNGTSMISLIMPPRDQISRVTKMLGDEFGTASNIKSRVNRQSVLGAITSAQQRLKLYNKVPPNGLVLYTGTIVTDDGKEKKVTIDFEPFRPINASLYLCDNKFHTEALNELLESDDKFGFIVMDGNGTLFGTLSGNTREVLHKFSVDLPKKHGRGGQSALRFARLRMEKRHNYVRKTAELATQFYINPATSQPNVSGLILAGSADFKTELSQSDMFDPRLQAKILNVVDVSYGGENGFNQAIELSAEILSNVKFIQEKRLIGKYFEEISQDTGKYVFGVDDTLKALEMGAVETLIVWENLDMNRYVLKNSATGEVVIKHLNKEQDADQSNFRDPESNADFEVQEKLSLLEWFANEYKRFGCTLEFVTNKSQEGSQFCRGFGGIGGILRYQLDMRSFDDFSDDGGVYDDSE

SEQ ID NO: 15 - DNA, 1314 bp, Glycine max
atgtctgacggtcaagaatcagacaagaatattgagatatggaagatcaagaaattgataaaggcattggaagctgctcgaggtaatggtaccagcatgatttctctgataatgcctccacgtgatcaaatatctcgggtcactaagatgttgggagatgaatttggaactgcttcaaacatcaaaagtagggtgaaccgacagtctgtgttgggagccattacttctgctcagcagaggttgaaactatataacaaggtccctccaaatggtttggttctttacactggaaccattgtcactgaagatggcaaggaaaagaaggtgacaattgattttgagcctttcaagcctatcaatgcatcactgtacctctgtgataacaagtttcacacagaagctctaaatgaacttttagaatctgatgacaagtttggtttcattgtgatggatggaaatggcaccctttttgggactttaagtggaaacactcgtgaggtacttcacaaatttactgttgatctaccaaagaagcatggtagaggaggtcaatcagctttgcgttttgctcgacttaggatggaaaagcggcacaactatgttaggaaaactgcagaacttgctactcagtttttcatcaatcctgccaccagtcaacctaatgtttctggacttatacttgctggttctgctgacttcaagactgagttgagtcagtcagatatgtttgaccctcgattgcaagcaaaaatattgaatgtggtagatgtttcttatggtggggaaaatggattcaatcaagctattgagctatctgcagagattttatcaaatgtgaagttcattcaagagaaacgcttgatagggaaatattttgaagagatcagccaggacactgggaaatatgtctttggggttgaggacactttgaaggcactggagatgggtgctgtggaaacactcattgtatgggaaaatttggatattaataggtatgtgctgaaaaatggtatcactggtgagattgtcattaagcacttgaacaaggaacaagaggctaatcaaagcaacttccgtgatttggccacttctgcagagttggaagttcaggagaagatgcccttgctcgagtggtttgccaatgagtacaaaaaatttggatgctccctggaatttgtgaccaacaaatctcaagagggctcccaattctgcagagggtttggtggcattggtggaattcttcgttaccagcttgacatcagatcatttgatgagttatctgatgatggagaagtgtatgaggattctgattaa

SEQ ID NO: 16 - protein, 437 aa, Glycine max
MSDGQESDKNIEIWKIKKLIKALEAARGNGTSMISLIMPPRDQISRVTKMLGDEFGTASNIKSRVNRQSVLGAITSAQQRLKLYNKVPPNGLVLYTGTIVTEDGKEKKVTIDFEPFKPINASLYLCDNKFHTEALNELLESDDKFGFIVMDGNGTLFGTLSGNTREVLHKFTVDLPKKHGRGGQSALRFARLRMEKRHNYVRKTAELATQFFINPATSQPNVSGLILAGSADFKTELSQSDMFDPRLQAKILNVVDVSYGGENGFNQAIELSAEILSNVKFIQEKRLIGKYFEEISQDTGKYVFGVEDTLKALEMGAVETLIVWENLDINRYVLKNGITGEIVIKHLNKEQEANQSNFRDLATSAELEVQEKMPLLEWFANEYKKFGCSLEFVTNKSQEGSQFCRGFGGIGGILRYQLDIRSFDELSDDGEVYEDSD

SEQ ID NO: 17 - DNA, 1314 bp, Hordeum vulgare
atgtctgagagccaggaaactgataggaacattgaaatctggaagattaaaaagctaatcaaggcactggagtctgctagaggcaatggcacaagcatgatctcccttattatgcctccacgggatcaggtttctcgagtggcgaagatgttaggtgacgagtatggtactgcttcaaatatcaagagtagagtcaatcgtcaatcagttttgggtgccatcacctcagctcagcagaggctgaagctttataacagagttcctcccaatggtttggttctctatactggaactattgttactgatgatggaaaggaaaagaaagttactattgatttcgagccattcaagcctataaatgtctcactgtatctttgtgataacaagttccacaccgaggctttaaatgagctattggaatctgatgacaagtttggcttcattgttatggatggtaatggcacactttttggcacgctaagtggaaatacccgtgaggtgcttcacaaatttactgttgatctcccgaagaagcatggtagaggaggacagtcggctctacgttttgctcgtctccggatggaaaaacgtcataactatgtccgaaaaactgctgagcttgctactcagtttttcattaacccagctacaagtcagcctaatgtttctggactaattcttgctggttctgccgatttcaagacagagctgagccaatctgatatgtttgaccagagacttcaagccaagatacttaatgtggttgatgtttcctatggtggtgagaatggtttcaaccaagcaattgagttgtcagctgatattctagcaaatgtgaagttcatacaggagaagaagttaattgggaagtactttgaagagattagtcaagatactgggaagtatgtctttggtgttgatgacaccctgaaggctcttgaaatgggtgctgttgaaactttgatggtgtgggaaaaccttgatgtcaatcggtatgtgcttaagcacagtgcaactggagaaattatcataaagcatctgaacaaagaaactgaaaccgaccagagcaacttccgtgatccatccaccaacgctgagttagaagtccaggagaagacctcacttttggaatggtttgctaatgaatacaagaagtttgggtgcacccttgaatttgttaccaataaatctcaggagggatcacagttctgtagagggtttggtggcattggtggtatcctgcgctatcagctggacattcgttcctttgatgatcttgatgacgatgagggtgtctatgaagattctgactag

SEQ ID NO: 18 - protein, 437 aa, Hordeum vulgare
MSESQETDRNIEIWKIKKLIKALESARGNGTSMISLIMPPRDQVSRVAKMLGDEYGTASNIKSRVNRQSVLGAITSAQQRLKLYNRVPPNGLVLYTGTIVTDDGKEKKVTIDFEPFKPINVSLYLCDNKFHTEALNELLESDDKFGFIVMDGNGTLFGTLSGNTREVLHKFTVDLPKKHGRGGQSALRFARLRMEKRHNYVRKTAELATQFFINPATSQPNVSGLILAGSADFKTELSQSDMFDQRLQAKILNVVDVSYGGENGFNQAIELSADILANVKFIQEKKLIGKYFEEISQDTGKYVFGVDDTLKALEMGAVETLMVWENLDVNRYVLKHSATGEIIIKHLNKETETDQSNFRDPSTNAELEVQEKTSLLEWFANEYKKFGCTLEFVTNKSQEGSQFCRGFGGIGGILRYQLDIRSFDDLDDDEGVYEDSD

SEQ ID NO: 19 - DNA, 1308 bp, Medicago truncatula
atggctgatggtgaatcggacaagaatattgagatatggaagatcaaaaagttgatcaaaggactggaagctgcaagaggtaatggtactagcatgatttctctgataatgcctccacgcgatcaaatatctcgtgtcactaagatgttgggagatgaatttggaactgcttcaaacatcaaaagtagggtaaaccggcaatcagtgcttggagccattacttctgcacaacagaggttgaaactttataataaggttcctccaaatggattggttctgtatactggtaccattctcactgaggacggcaaggaaaagaaggtgacgtttgattttgaacctttcaaaccaatcaatgcatcactttatctctgcgacaacaaatttcacacagaagctctaaatgaacttctagaatctgatgacaagtttggttttattgttatggatggaaatggaacccttttcgggacattaagtggaaatactcgtgaggtgcttcataaatttactgttgatctaccaaagaaacatggtagaggaggacagtcagctttgcgttttgctcgtcttcggatggaaaaacgacacaattacgtcaggaagactgcagaacttgccactcagttttacatcaaccctgctaccagtcagcctaatgttgctggactcattcttgctggttcagctgacttcaagactgagctgagtcaatcagatatgtttgatcctcgtttgcaagcaaaaatattaaatgtggttgatgtctcttatggtggggaaaatggctttaatcaagctattgaattatctgcagagattctatctaatgtgaagttcattcaagagaaacgcttgataggaaaatattttgaagagataagccaagaaactggtaaatatgtttacggagttgatgacacattgaaggctctagaaatgggtgcggttgaaacactcattgtatgggagaatttggatattactaggtatgtgctgaaaaatgctaccactggtgagattgtaataaagcatttgaagaagggacaagaaaatgatcaaagcaacttccgcgatgtggccacatctgcagatttggaggttcaggagaagatgccgttacttgagtggtttgcgaatgagtacaaaagatttggatgctcgctggaattcgtgaccaacaaatctcaagaagggtcacagttttgcagagggtttggtggtattggaggtatgcttcgctaccagcttgatatcagatcatttgatgagttatctgatgatgaagtgtacgaggattctgattaa

SEQ ID NO: 20 - protein, 435 aa, Medicago truncatula
MADGESDKNIEIWKIKKLIKGLEAARGNGTSMISLIMPPRDQISRVTKMLGDEFGTASNIKSRVNRQSVLGAITSAQQRLKLYNKVPPNGLVLYTGTILTEDGKEKKVTFDFEPFKPINASLYLCDNKFHTEALNELLESDDKFGFIVMDGNGTLFGTLSGNTREVLHKFTVDLPKKHGRGGQSALRFARLRMEKRHNYVRKTAELATQFYINPATSQPNVAGLILAGSADFKTELSQSDMFDPRLQAKILNVVDVSYGGENGFNQAIELSAEILSNVKFIQEKRLIGKYFEEISQETGKYVYGVDDTLKALEMGAVETLIVWENLDITRYVLKNATTGEIVIKHLKKGQENDQSNFRDVATSADLEVQEKMPLLEWFANEYKRFGCSLEFVTNKSQEGSQFCRGFGGIGGMLRYQLDIRSFDELSDDEVYEDSD

SEQ ID NO: 21 - DNA, 1311 bp, Oryza sativa
atggctgacagccatgaaactgacaagaacattgagatctggaaggtcaagaagttgattaaaggacttgatgctgcacgtggaaatgggacgagcatgatatcactgatcatgccacctcgtgatcaggtctctcgagtcaccaagatgttgggtgatgaatacggaactgcctcaaacatcaagagcagagtcaacaggcaatctgttttggctgctatcacatctgctcaacaaaggttgaagctgtacaaccgagttccccccaatggattagtgctttacactggaaccattgtcacagacgagggcaaagaaaagaaagtcaccgttgactttgagccgttcaggccaatcaatgcttcattgtacctttgtgacaacaagtttcacaccgaagcgttgaatgagctgttggaatctgatgacaagtttggcttcatcatcatggatggcaacgggacgctgttcggaacactcagtggcaactcaagagaagttcttcataagttttctgttgatctccccaagaaacatggacgaggagggcagtcagcacttcgctttgcccgcctacgcatggagaaacgccacaactatgtgcgcaagacagctgagcttgctacccaattcttcatcaaccctgccaccagccagccaaatgtttctgggctcattatagctggttctgctgactttaagactgaattgagtcaatctgacatgtttgatcagcgtctacaagccaagatactcaaggtggttgacgtttcttatggtggggagaatggctttaaccaggctattgagatatctgctgaagagctttcaaatgtcaagttcattcaagaaaagaagttgattgggaagtattttgaagagattagccaagacactgggaagtatgtttttagtgtggatgatacgatgtcagcacttgaaatgggtgcagttgagacactgattgtgtgggaaaatcttgatatcaaccgatatgttttgaaaaattctgtcactggagaaactacggtaaagcacctcaacaaggcacaggagacagatcagagcaacttccgagataaggcgacttctgcagaactggaggtaatagaaaagaccttgttgctcgagtggtttgcagaaaattaccggcaatttggttgcagcctagagtttgtcacgaacaagtcgcaggaaggttctcagtttgtcaggggctttggtgggataggggggattctccgctatcaggttgagatcaatgcttacgaagacttgtctgatgaggagtacgatgaagactacgaatag

SEQ ID NO: 22 - protein, 436 aa, Oryza sativa
MADSHETDKNIEIWKVKKLIKGLDAARGNGTSMISLIMPPRDQVSRVTKMLGDEYGTASNIKSRVNRQSVLAAITSAQQRLKLYNRVPPNGLVLYTGTIVTDEGKEKKVTVDFEPFRPINASLYLCDNKFHTEALNELLESDDKFGFIIMDGNGTLFGTLSGNSREVLHKFSVDLPKKHGRGGQSALRFARLRMEKRHNYVRKTAELATQFFINPATSQPNVSGLIIAGSADFKTELSQSDMFDQRLQAKILKVVDVSYGGENGFNQAIEISAEELSNVKFIQEKKLIGKYFEEISQDTGKYVFSVDDTMSALEMGAVETLIVWENLDINRYVLKNSVTGETTVKHLNKAQETDQSNFRDKATSAELEVIEKTLLLEWFAENYRQFGCSLEFVTNKSQEGSQFVRGFGGIGGILRYQVEINAYEDLSDEEYDEDYE

SEQ ID NO: 23 - DNA, 1314 bp, Oryza sativa
atgtcagatggtcaagaaactgacaagaatattgagatttggaagattaagaagttgatcaaggcactggagtctgctagaggcaatggcacaagcatgatctctctgattatgcccccacgtgatcaagtctcccgtgtgaccaagatgctgggtgatgaatatggtactgcttcaaacatcaagagtagagtcaatcgacaatctgttttggcagccatcacatcagctcaacagaggctgaagctgtacaacaaggttccgccaaatggactcgtcctctacacaggaacaattgttactgaagatggcaaggaaaagaaagtcactattgattttgaaccattcaagcccatcaatgcatcgttgtatctctgtgacaacaaattccacaccgaagctttgaatgagctcttggaatccgatgacaagtttggctttattgttatggatggtaatggaactcttttcggcacactgagtggcaatactcgtgagatccttcacaaattcactgtagatctcccaaagaaacatggaagaggagggcaatctgctctgcgttttgctcggcttcggatggaaaagcgtcataactatgtccgaaagacggctgaacttgctactcagttcttcatcaatccagctaccagtcagcctaatgtttctggactaattttggctggttctgctgattttaagacagaactgagtcaatctgacatgtttgatcagcgtcttcaagccaagatacttaatgttgttgatgtttcctatggtggtgaaaatggtttcaaccaagccattgagttatcagctgaaattctagcgaatgtgaagttcatacaggagaaaaagttgattgggaagtactttgaagagattagtcaagataccgggaagtacgtttttggcgttgatgacacccttaagactcttgaaatgggtgctgttgagacattgatagtgtgggaaaaccttgatgtcaacagatatgtgcttaagaacagtgctactggagaaactgcaataaaacatctgaacaaagagcaagaagctgatcagagcaatttccgcgacacatcaaccaatgctgagttagaagttcaggacaaaacatcccttctggagtggtttgctaacgagtacaaaaagttcggatgcacacttgagttcgttaccaacaaatcccaggaggggtcacagttttgcagaggttttggtggcatcggtggcatcttgcgctatcagctggacattcgttcttttgatgagctttctgatgatgagggcgtctatgaagactctgattaa

SEQ ID NO: 24 - protein, 437 aa, Oryza sativa
MSDGQETDKNIEIWKIKKLIKALESARGNGTSMISLIMPPRDQVSRVTKMLGDEYGTASNIKSRVNRQSVLAAITSAQQRLKLYNKVPPNGLVLYTGTIVTEDGKEKKVTIDFEPFKPINASLYLCDNKFHTEALNELLESDDKFGFIVMDGNGTLFGTLSGNTREILHKFTVDLPKKHGRGGQSALRFARLRMEKRHNYVRKTAELATQFFINPATSQPNVSGLILAGSADFKTELSQSDMFDQRLQAKILNVVDVSYGGENGFNQAIELSAEILANVKFIQEKKLIGKYFEEISQDTGKYVFGVDDTLKTLEMGAVETLIVWENLDVNRYVLKNSATGETAIKHLNKEQEADQSNFRDTSTNAELEVQDKTSLLEWFANEYKKFGCTLEFVTNKSQEGSQFCRGFGGIGGILRYQLDIRSFDELSDDEGVYEDSD

SEQ ID NO: 25 - DNA, 1314 bp, Picea glauca
atggcagatggacaggagactgataagaatattgagatatggaagatcaagaaattgataaaagccctggaatctgctaggggtaatggtacaagtatgatatctttaattatgcctccgagggatcaaatctcacgtgtcacaaaaatgcttggtgatgaatttggaacagcatccaacatcaagagtagagtgaaccgacaatccgttctaggtgccatcacatctgcacagcaaaggctgaaactttacaacaaggttcctccaaatggtttggtgctttataccggaaccattgtcactgatgatgggaaagaaaagaaagttacaattgattttgagcctttcaagcctattaatgcatctctgtatctttgtgataacaagttccataccgaggcacttaatgaactcttggaatctgatgataagtttggatttatagtcatggatggtaatggtacactgtttggtaccctgagtggtaacactcgtgaagtgcttcacaaattcactgttgatcttcctaaaaaacatggaagaggaggacagtcagccttgcgttttgcacgtcttcgaatggaaaaacgtcataattatgtaaggaagacagcagagctagcaactcaattttatataaatcctgctactagccagcccaatgtttcaggtttgattttggctggatcggcagattttaaaacagaattgagccagtctgacatgtttgatcccaggctacaagctaagattctaaatgtggtggatgtatcctatgggggagaaaatggtttcaatcaagcgattgaactatcatcagagatactatcaaatgtaaaatttatacaagagaaacgtctaataggaaaatactttgaggagataagccaggatacaggaaaatatgtttttggggttgaagacactctcaaggcattggagatgggtgctgttgaaaccttgatagtatgggagaatttggatattagcagatatgtcttgaagaattcagtgactggggaaatacttataaagcacttgagtaaagatcaagagactgatcaaagcaatttcagggattcagctacacctgccgagctggaagttcaggagaaaacatccttattggagtggtttgcaaatgagtataagcgcttcggttgcagtcttgagtttgttaccaacaaatcccaggagggttctcaattttgtaggggctttggtggtattggtggcatccttcggtaccagctagatatgaggacttttgatgagttgtctgatgatggaggtgtttacgaagattcagactag

SEQ ID NO: 26 - protein, 437 aa, Picea glauca
MADGQETDKNIEIWKIKKLIKALESARGNGTSMISLIMPPRDQISRVTKMLGDEFGTASNIKSRVNRQSVLGAITSAQQRLKLYNKVPPNGLVLYTGTIVTDDGKEKKVTIDFEPFKPINASLYLCDNKFHTEALNELLESDDKFGFIVMDGNGTLFGTLSGNTREVLHKFTVDLPKKHGRGGQSALRFARLRMEKRHNYVRKTAELATQFYINPATSQPNVSGLILAGSADFKTELSQSDMFDPRLQAKILNVVDVSYGGENGFNQAIELSSEILSNVKFIQEKRLIGKYFEEISQDTGKYVFGVEDTLKALEMGAVETLIVWENLDISRYVLKNSVTGEILIKHLSKDQETDQSNFRDSATPAELEVQEKTSLLEWFANEYKRFGCSLEFVTNKSQEGSQFCRGFGGIGGILRYQLDMRTFDELSDDGGVYEDSD

SEQ ID NO: 27 - DNA, 1329 bp, Physcomitrella patens
atggcggactttggcggaggaccagacgaggacaagaatattacgatatggaaaattaagaaactcatcaaggccttggagtcggctcgcggcaatggaacgtccatgatttcgctcatcatgcctcctagggatcaagtttcccgggtgactaagatgctcggagacgagtttgggacagcttccaatatcaagaacagggtgaacaggcagtccgtgttgggagccatcacgtctgcgcagcaaaggctgaaactgtacaacaaggtgcccccaaacgggctggtgctgtacacaggcacaattgtgacggacgatggcaaggagaagaaggtgacgatcgacttcgagccgttcaagcccatcaatgcatcgctgtatctgtgcgacaacaagttccacacggaggcgttgaacgagctgctggagtcggacgacaagttcgggttcatcgtgatggacggaaacgggacgctgtttgggactctgagcgggaacacgcgcgaggtgctgcacaagttcacggtggatctaccgaagaagcacggtcgtggagggcagtcggcgctgcgtttcgctcggctgcggatggagaagaggcacaattacgtgcggaagacggcggagctggcgacgcagttctacatcaacccggcgacgagtcagccgaatgtgtcagggttgattctggcgggttcggcggattttaagacggagctgagccagtcggacatgttcgatcctcggctgcaagcgaaggtgctgaacgtagtggacgtgtcgtacgggggggacaacgggttcaaccaggcgatcgagctgtcggcggagattctggcgaacgtaaagttcatacaggagaagaggctgatcgggaagtacttcgacgagatcagtcaggacacggggaagtacgtgttcgggatcgacgacacgctgaaggctctggagatgggggcggtggagacattgatcgtgtgggagaacttggacacgaaccgatacgtgctgaagaacgcggtaactggggagatcgtgatcaagcatctcaccaaggagcaagaagcggaccaatccaacttcagggtgtcagagtctcaggcagagttggaggttcaggaaaagttgtcacttttggagtggcttgctaatgagtacaggagtttcggttgtgcgttggaatttgttacgaacaagtctcaggaagggtcacagttttgtcgaggatttggaggattcggtggaattttgcgttatcaacttgatatgcgcacgtttgacgaattatcagacggagattacgatgaggattttgatgaggattattag

SEQ ID NO: 28 - protein, 442 aa, Physcomitrella patens
MADFGGGPDEDKNITIWKIKKLIKALESARGNGTSMISLIMPPRDQVSRVTKMLGDEFGTASNIKNRVNRQSVLGAITSAQQRLKLYNKVPPNGLVLYTGTIVTDDGKEKKVTIDFEPFKPINASLYLCDNKFHTEALNELLESDDKFGFIVMDGNGTLFGTLSGNTREVLHKFTVDLPKKHGRGGQSALRFARLRMEKRHNYVRKTAELATQFYINPATSQPNVSGLILAGSADFKTELSQSDMFDPRLQAKVLNVVDVSYGGDNGFNQAIELSAEILANVKFIQEKRLIGKYFDEISQDTGKYVFGIDDTLKALEMGAVETLIVWENLDTNRYVLKNAVTGEIVIKHLTKEQEADQSNFRVSESQAELEVQEKLSLLEWLANEYRSFGCALEFVTNKSQEGSQFCRGFGGFGGILRYQLDMRTFDELSDGDYDEDFDEDY

SEQ ID NO: 29 - DNA, 1311 bp, Populus trichocarpa
atgtcagacggtcatgagactgataagaacattgagatttggaagattaagaagcttatcaaagcactggaagctgcccgaggtaatggcacaagcatgatttcccttatcatgcctcctcgtgatcaggtttctcgtgtcactaagatgcttggagatgagtttggaactgcttcaaacattaagagcagggtcaatcgtcaatctgttctgggtgccattacatctgctcagcaaaggctcaaactttacaacaaggttcctcccaatgggcttgtgctttacaccggaacaattgtaaccgaagatgggaaggaaaagaaagtaactattgactttgagcctttcaggcccataaatgcatctctttacctctgtgacaacaaatttcacacagaagctctgaatgaactcttggaatccgatgacaagttcggctttattgtcatggacgggaatggaactctttttgggacactgagtggcaacaccagagaagtgctgcataagtttaccgttgaccttcctaagaagcatgggagaggaggacagtctgctcttcgatttgctcgacttcgaatggagaagcgccacaactatgtgagaaagacagcagaacttgccacccagttctatatcaatcctgccaccagccagcctaatgtttcgggattgatacttgctggatcagctgacttcaagactgagctgagtcaatcagatatgtttgatcctcgacttcaggcaaaaattctgaatgttgttgatgtttcctatggaggagagaatggttttaatcaggcaatcgagctgtcagcggaaattctttccaatgtgaaatttatacaggagaagcgcttgataggaaagtactttgaagagataagtcaggatactgggaaatatgtttttggtgtagatgacacactgaaagctttggaaatgggtgctgttgaaactttaattgtttgggaaagtttggatattaataggtaccagttgaaaaactctgccactggtgaagttaccataaaacattggaataaggagcaggaatccaaccagggcaactttagggattcagtaaccaatgctgaattagaagttcaggataagactccactgctggagtggtttgctaacgagtacaagcggtttggttgctctctagagtttgttactaacaaatcacaagaaggatcccagttttgtagagggtttggcgggattggtgggatcctccgttaccagcttgatatgagatcatttgatgagctttcagatgaagaagtttatgatgattctgaatag

SEQ ID NO: 30 - protein, 436 aa, Populus trichocarpa
MSDGHETDKNIEIWKIKKLIKALEAARGNGTSMISLIMPPRDQVSRVTKMLGDEFGTASNIKSRVNRQSVLGAITSAQQRLKLYNKVPPNGLVLYTGTIVTEDGKEKKVTIDFEPFRPINASLYLCDNKFHTEALNELLESDDKFGFIVMDGNGTLFGTLSGNTREVLHKFTVDLPKKHGRGGQSALRFARLRMEKRHNYVRKTAELATQFYINPATSQPNVSGLILAGSADFKTELSQSDMFDPRLQAKILNVVDVSYGGENGFNQAIELSAEILSNVKFIQEKRLIGKYFEEISQDTGKYVFGVDDTLKALEMGAVETLIVWESLDINRYQLKNSATGEVTIKHWNKEQESNQGNFRDSVTNAELEVQDKTPLLEWFANEYKRFGCSLEFVTNKSQEGSQFCRGFGGIGGILRYQLDMRSFDELSDEEVYDDSE

SEQ ID NO: 31 - DNA, 1311 bp, Populus trichocarpa
atggctgatggtcatgagtcggacaagaatattgagatatggaaaatcaaaaagttgattaaggcattggagtctgcaaggggtaatggcacgagcatgatatctcttataatgcctcctcgtgatcaaatatctcgggtcacaaagatgttaggtgatgaatttggaactgcttcaaacattaaaagtagggtcaaccgccagtctgtcttgggtgccatcacatctgctcagcagaggctgaagctttataacaaggttccgccgaatgggctggtgctttatacgggaacaattgttactgaagatggaaaagagaagaaggtgacaattgattttgaacctttcaaacctataaacgcatcattgtacctctgtgacaacaagtttcacacagaagcactcaatgagctcttagagtctgatgacaagtttggttttattgtcatggatgggaacggcaccttatttgggacactgagtggaaacacacgagaagtgctccataaatttactgttgatttgccaaagaagcacggaagaggagggcagtctgctctgcggtttgctcgacttcggatggaaaaacggcacaactatgtgaggaaaactgcagagcttgccacccagttcttcattaatcctgctaccagtcagcccaatgttgctgggttgatactagctggttcagctgacttcaagactgagctcagccagtcagatatgtttgacccaaggttgcaagccaagatattgaacgtggttgatgtttcatatggtggagaaaatggtttcaaccaagctattgagctgtcagctgagattctatcaaatgtgaagtttatacaggaaaaacgtttgatagggaaatactttgaggagatcagccaggatactgggaagtatgtctttggtgttgatgatacattgaaggctctggaaatgggtgctgtcgaaatccttatcgtgtgggaaaatctagatatcaataggtacacgctgaaaaacagtgctacaggagaaattatcataaagcacttgaacaaggaccaagaggctgatcagaataactttcgggattcagccactgctgcagagttggaggttcaggagaagatgcccttgcttgagtggtttgccaatgagtacaagcgatttggttgtacacttgaattcgtcaccaataaatcacaagagggatcgcagttttgcagggggtttggtggaattggcggtattcttcgctaccagcttgacatgcgatcatttgatgagttgtccgatggagaagtttatgaggattccgattag

SEQ ID NO: 32 - protein, 436 aa, Populus trichocarpa
MADGHESDKNIEIWKIKKLIKALESARGNGTSMISLIMPPRDQISRVTKMLGDEFGTASNIKSRVNRQSVLGAITSAQQRLKLYNKVPPNGLVLYTGTIVTEDGKEKKVTIDFEPFKPINASLYLCDNKFHTEALNELLESDDKFGFIVMDGNGTLFGTLSGNTREVLHKFTVDLPKKHGRGGQSALRFARLRMEKRHNYVRKTAELATQFFINPATSQPNVAGLILAGSADFKTELSQSDMFDPRLQAKILNVVDVSYGGENGFNQAIELSAEILSNVKFIQEKRLIGKYFEEISQDTGKYVFGVDDTLKALEMGAVEILIVWENLDINRYTLKNSATGEIIIKHLNKDQEADQNNFRDSATAAELEVQEKMPLLEWFANEYKRFGCTLEFVTNKSQEGSQFCRGFGGIGGILRYQLDMRSFDELSDGEVYEDSD

SEQ ID NO: 33 - DNA, 1314 bp, Solanum lycopersicum
atggcagatggccaagaaaatgataagaatattgaaatatggaaaatgaaaaaattaatcaaagccctacaatctgccagaggaaatggcaccagcatgatctctcttatcataccccctggtgatcagatatctcgtattaccaagatgctggcagaagaatatggtactgcatcaaatattaagagcagagtaaaccgtcagtctgtgcttggtgcaataacgtctgctcagcagaggcttaaactttataacaaagttcctcctaatggtttgctgctttacactggaactatagtgacggatgatggaaaggaaaagaaggtcacctttgatcttacgccttttaaacccataaatgcgtctctatacttatgtgacaacaaatttcatactgaacctcttggtgaattgttggaatctgatgagaagtttggtttcattgtcatggatggtaatgggaccctttttgggaccttgagtggcaacacccgagaagttcttcataagttcactgttgatctcccaaagaagcatggaagaggaggtcaatcagctcttcggtttgctcgtcttcgaatggagaaacgtcataattatgtgagaaagacagcagagcttgctactcaattcttcattaacccagccactagccagccaaatgtatctggactaatacttgctggatcagctgatttcaagacggagctaagccaatctgatatgtttgatccacgtctacaagcaaagatacttaatgtggttgatgtgtcctatggtggagaaaatggcttcaatcaggcaatcgagctgtctgcagagatactggcaaatgtgaagtttatacaagaaaagcgcttgatagggaaattctttgaggaaatcagtcaagatactggcaagtatgtattcggtgtggatgacacaataaaaggtttggagatgggagctgttgaaactctaattgtgtgggaaaatcttgatataaaccgttacgtattgaaaaacagtgtgactaatgagatcgtcattaagcacctaaacaaggagcaagaggctgataatagtaactttaaggattctgccacatcagctgaattggaggttcaggataaaatgcccctgttggagtggtttgccaatgaatacaaaacttttggttgttcacttgagtttgtcactaacaggtctcaagaggggtcacagttctgcagaggatttggtggcattggaggaatccttcgctaccagcttgacatgcgttcctttgatgagccatctgatgaaggagaatactttgtggattctgattaa

SEQ ID NO: 34 - protein, 437 aa, Solanum lycopersicum
MADGQENDKNIEIWKMKKLIKALQSARGNGTSMISLIIPPGDQISRITKMLAEEYGTASNIKSRVNRQSVLGAITSAQQRLKLYNKVPPNGLLLYTGTIVTDDGKEKKVTFDLTPFKPINASLYLCDNKFHTEPLGELLESDEKFGFIVMDGNGTLFGTLSGNTREVLHKFTVDLPKKHGRGGQSALRFARLRMEKRHNYVRKTAELATQFFINPATSQPNVSGLILAGSADFKTELSQSDMFDPRLQAKILNVVDVSYGGENGFNQAIELSAEILANVKFIQEKRLIGKFFEEISQDTGKYVFGVDDTIKGLEMGAVETLIVWENLDINRYVLKNSVTNEIVIKHLNKEQEADNSNFKDSATSAELEVQDKMPLLEWFANEYKTFGCSLEFVTNRSQEGSQFCRGFGGIGGILRYQLDMRSFDEPSDEGEYFVDSD

SEQ ID NO: 35 - DNA, 1314 bp, Solanum tuberosum
atggctgacagtcatgataatgataagaatatcgagatatggaagatcaagaaacttataaaggcactcgaagctgctcgaggcaatggtaccagcatgatttctctaatcatgcctccacgggatcaagtatctagggtcactaagatgcttggagatgagttcggaactgcatcaaacatcaaaagtagagtgaatcgtcaatctgtgctgggtgcaatcacatctgctcagcagagacttaaactctataacaaggttccaccaaatgggcttgtgctttataccggaacaatcataactgaagatgggaaagagaagaaggttacaattgattttgagcccttcaggcccattaatgcatctctatatctttgtgataacaagttccacacagaagccttgaatgagcttttggaatccgatgacaagttcgggtttattgtgatggatgggaatgggacactttttgggacactgagtggcaataccagggaggtccttcacaagtttagtgttgatctgcccaaaaaacatggaagaggaggtcagtctgctctgcgttttgctcgtcttcggatggagaaacgtcacaactatgtgaggaaaacagctgagcttgcaacccagttttatattaatcctgccactagccagcctaacgtttcaggtctgatactagctggatcagctgactttaagacggagcttagccagtctgacatgtttgatcctcgtcttcaggcaaagattttaaatgtggttgatgtttcttatggaggggaaaatggtttcaaccaagcaattgagctgtctgctgaggtcttggccaatgtgaaatttatacaagagaagaagttgataggcaagtattttgaggagatcagtcaggacaccgggaagtatgtttttgggattgatgataccttgaaagttctggaaatgggtgctattgagacccttattgtgtgggaaaatctggacattaataggtatgtgctgaaaaataacacttccggggaaacaatcatcaaacacttgaacaaggagcaagacactgtccaaagtaacttccgtgatcctgatacaaatgctgaattagaagttcaggataaattgtcactacttgagtggtttgcgaatgaatacaggagatttggttgtagtttggagtttgttaccaacaaatcacaggaaggatctcagttttgccgtggttttggtggcattggaggaattctccgctaccagcttgatgttagagcttttgatgaactttctgatgatggtgaagtttacgaagattctgaatag

SEQ ID NO: 36 - protein, 437 aa, Solanum tuberosum
MADSHDNDKNIEIWKIKKLIKALEAARGNGTSMISLIMPPRDQVSRVTKMLGDEFGTASNIKSRVNRQSVLGAITSAQQRLKLYNKVPPNGLVLYTGTIITEDGKEKKVTIDFEPFRPINASLYLCDNKFHTEALNELLESDDKFGFIVMDGNGTLFGTLSGNTREVLHKFSVDLPKKHGRGGQSALRFARLRMEKRHNYVRKTAELATQFYINPATSQPNVSGLILAGSADFKTELSQSDMFDPRLQAKILNVVDVSYGGENGFNQAIELSAEVLANVKFIQEKKLIGKYFEEISQDTGKYVFGIDDTLKVLEMGAIETLIVWENLDINRYVLKNNTSGETIIKHLNKEQDTVQSNFRDPDTNAELEVQDKLSLLEWFANEYRRFGCSLEFVTNKSQEGSQFCRGFGGIGGILRYQLDVRAFDELSDDGEVYEDSE

SEQ ID NO: 37 - DNA, 1314 bp, Vitis vinifera
atggcagatggtcatgaaacagataagaacattgagatatggaagatcaaaaagttgatcaaggcactggaagctgctcgaggcaacgggacaagcatgatttctcttatcatgcctccgcgggatcaaatatcaagggttactaagatgctgggagatgagtttggcacagcttcaaacattaaaagcagggtgaatcgtcaatctgttttgggagcaatcacatctgcacagcaaagattgaagttgtacaacaaggttcctcccaatgggcttgtgctgtacactggtactattgtgacagaagatggaaaggagaagaaggtgactattgactttgagccttttaggcctataaatgcttccctttacctatgtgacaacaaattccatacagaagcattgaatgaacttttggaatctgatgacaagtttggttttattgttatggatggaaatggtaccctctttggcacattaagtggcaatactcgtgaggtgcttcataaatttactgttgacctcccaaagaaacatggaagaggcgggcaatcagcactacggtttgctcgtcttcgaatggagaagcgtcacaactatgtgaggaagacagcagagcttgctacacaattttttatcaatcctgccactagccagcccaatgttgcaggattaatactggctggctcagctgacttcaagactgagctgagtcagtctgacatgtttgatccccgtcttcaggccaaaatacttaatgtagtggatgtttcttatggaggggagaatggtttcaatcaggcaatcgagttgtcctcagagatcttatccaatgtgaagttcattcaggagaagcgcttgattggtaaatactttgaggagatcagtcaggacactggaaagtatgtctttggtgtggaagatacactgaaagctttggagatgggtgctgttgagatactgattgtgtgggagaatctggacatgaataggtatgttcttaaaaacagcagcacaggtgagattgtcataaaacacttgaacaaggaacaagaggctgatcaaaacaccttcagggattcagctacctctgctgaattggaggttcaggaaaagatgtcattgctagagtggtttgccaatgagtacaagcgctttggttgtacacttgagtttgtcaccaacaaatcacaagagggatcccagttctgcaggggctttggtgggattggtggaatcctccgttaccagctagacatgcgatcatttgatgagctttctgatgatggagaaaactacgatgattctgaatag

SEQ ID NO: 38 - protein, 437 aa, Vitis vinifera
MADGHETDKNIEIWKIKKLIKALEAARGNGTSMISLIMPPRDQISRVTKMLGDEFGTASNIKSRVNRQSVLGAITSAQQRLKLYNKVPPNGLVLYTGTIVTEDGKEKKVTIDFEPFRPINASLYLCDNKFHTEALNELLESDDKFGFIVMDGNGTLFGTLSGNTREVLHKFTVDLPKKHGRGGQSALRFARLRMEKRHNYVRKTAELATQFFINPATSQPNVAGLILAGSADFKTELSQSDMFDPRLQAKILNVVDVSYGGENGFNQAIELSSEILSNVKFIQEKRLIGKYFEEISQDTGKYVFGVEDTLKALEMGAVEILIVWENLDMNRYVLKNSSTGEIVIKHLNKEQEADQNTFRDSATSAELEVQEKMSLLEWFANEYKRFGCTLEFVTNKSQEGSQFCRGFGGIGGILRYQLDMRSFDELSDDGENYDDSE

SEQ ID NO: 39 - DNA, 1314 bp, Aureococcus anophagefferens
atggaaaagggcgatggctctgggggccttgatgcccaagataagcaagttgaaatatggaaagtgaagaagcttgtcaaatcactgactctcgctcgcggaaatgggacgtcgatgatttccttggtgataccaccgcgtgatcagatttcacgagttgctaaaatgctcgccgatgaatacggtacggcttctaatattaaaagtcgtgttaatcgattatctgttctgggcgcgataactagtacacagcaacgtctcaagttgtattctcgagtgccgctgaacggtctggtcgtctactgtggtactataatgacagacgagggaaaggagagacgcgttaatatcgattttgaaccgtttaaaccaataaacacatcattatacctgtgtgataacaaattccacactgaagccctcgatgagctcttagaggatgacgacaagtttgggttcataatcatggatggtaatggatccctctacggtactcttcaagggaacaatcgcgaggtcctccacaaattttcggttgatctacccaagaagcatgggcgaggggggcaatctgcattgcggttcgcgaggctgcgaatggagaagcgtcacaactatgtccgcaaggtagctgagcttgctgtccaaatgtttatttcggctgacaagcccaatgttgcggggctcgtgttggccgggtctgctgatttcaaaagtgagcttcacacttccgatatgtttgatcaacgattggcgcgcgtcgtaattaagacggtcgatgtgagctatggtggagagattggcttcaaccaggctatcgagctctctgctgaaactctcggttctgttaaactcgtacaagagaagcggcttttgcagaagtattttgatgagatctcacaagatacaggaaagtactgcttcatggttgaggacacgcttaaagcactggaacttggtgctgtcgaaactctcgtagtctgggaaaatctcgacatagaccgtcttacgctgcgcaatcacgctgctggtgaagataaggtgctgcacctctccaaagagcagcaggcgcacgaggaatattttcatgatgcggcatctggtgttgaactagaagtcactgagaaagtttccctggttgagtttcttgcgaacaattacaagtctttcggaacgacgcttgagtttgtcacaaatcgatcacaggagggttctcagttttgccgcggctttggtggtattggtggcatactgcgctggcgtgttgatttcttggagatggagatggcagaagagagtgctgctgagatgtag

SEQ ID NO: 40 - protein, 437 aa, Aureococcus anophagefferens
MEKGDGSGGLDAQDKQVEIWKVKKLVKSLTLARGNGTSMISLVIPPRDQISRVAKMLADEYGTASNIKSRVNRLSVLGAITSTQQRLKLYSRVPLNGLVVYCGTIMTDEGKERRVNIDFEPFKPINTSLYLCDNKFHTEALDELLEDDDKFGFIIMDGNGSLYGTLQGNNREVLHKFSVDLPKKHGRGGQSALRFARLRMEKRHNYVRKVAELAVQMFISADKPNVAGLVLAGSADFKSELHTSDMFDQRLARVVIKTVDVSYGGEIGFNQAIELSAETLGSVKLVQEKRLLQKYFDEISQDTGKYCFMVEDTLKALELGAVETLVVWENLDIDRLTLRNHAAGEDKVLHLSKEQQAHEEYFHDAASGVELEVTEKVSLVEFLANNYKSFGTTLEFVTNRSQEGSQFCRGFGGIGGILRWRVDFLEMEMAEESAAEM

SEQ ID NO: 41 - DNA, 1326 bp, Dictyostelium discoideum
atgtcagctgttgatgatcaacaaaatgcagataagcaagttgaacaatggaaaatcaaaaaattaattaaaaatttggaagctgccagaggtaatggtacatctatgatttcattaattattcgtccaggtgatcaaattgcaaaagttaataaaatgttagcagaagagtatggtacagcatcaaatattaaatcaagagttaatagattatcagtattgggtgcaattacatcagcacaacaaagattaaagttatatactaaagtaccagataatggtttagttatttattgcggtacaatggttacagatgaaggtaaagagaaaccagtacgtatcgatattgaaccattcaaaccaatcaatacctcactctatttatgtgataataaattccatacagcaccattgggtgaattattagagagtgatgaaaagtttggtttcatcgtcgtagatggtaatggtgcactctttggtttattatgtggttcaaccagaacagttctccataagattacagtagatctcccaaagaaacacggtcgtggtggtcaatctgcccttcgtttcgctcgtcttcgtatggaaaaacgtcacaattacgttcgtaaagtttcagagttggccacccaattctacgtcaccaatgataaaccaaacgtttcaggtttgattttagctggttctgccgatttcaagactgaacttggtacctctgatatgtttgatcaacgtcttcgtgaaaagatcattaaaatcgtcgatgtttcctatggtggtgataatggtttcaatcaagctatcgaattatctggtgaagttctctcaagtgtcaaattcattcaagagaagaaattaatctcacaattctttgaagagatcgcacaagacactggtaagtattgtttcggtatcgctgatactttgaaagctttggacttgggtgctgctcacactttaatcgtttgggaatcattggaaacaattcgttacttacttcgtttaccaactggtgaagagaaagtcatctttttaaataaagatcaaaataaagatgcctctgtctttaaggataaagaatctggtcttgactatgaaatcgtcgaagaaatgccaatcgttgagtggttcgccaataactacaaaaactttggtgcctctctcgaattcgtcaccaacaaatctcaagaaggttcacaattctgtaaaggttttggtggtttgggtggtttactccgttatcaagtagatttcgctcaactcaatgatttcgataatccagatgagaatgaatacgatgatagtgattcagacttttga

SEQ ID NO: 42 - protein, 441 aa, Dictyostelium discoideum
MSAVDDQQNADKQVEQWKIKKLIKNLEAARGNGTSMISLIIRPGDQIAKVNKMLAEEYGTASNIKSRVNRLSVLGAITSAQQRLKLYTKVPDNGLVIYCGTMVTDEGKEKPVRIDIEPFKPINTSLYLCDNKFHTAPLGELLESDEKFGFIVVDGNGALFGLLCGSTRTVLHKITVDLPKKHGRGGQSALRFARLRMEKRHNYVRKVSELATQFYVTNDKPNVSGLILAGSADFKTELGTSDMFDQRLREKIIKIVDVSYGGDNGFNQAIELSGEVLSSVKFIQEKKLISQFFEEIAQDTGKYCFGIADTLKALDLGAAHTLIVWESLETIRYLLRLPTGEEKVIFLNKDQNKDASVFKDKESGLDYEIVEEMPIVEWFANNYKNFGASLEFVTNKSQEGSQFCKGFGGLGGLLRYQVDFAQLNDFDNPDENEYDDSDSDF

SEQ ID NO: 43 - DNA, 1284 bp, Plasmodium falciparum
atggaagaccacgatgctaatgtagaacaatggaaaataaaaagattaataaagaaacttgagaatgcaaaaggaaatggaaccagtatgattagtttgataattaaaaacaaagatgaagtttcaagaattaacaaaatgcttgctgatgaattgggaactgcttcaaatataaaaagcagagttaatagacttagtgttttgtctgccattacctcaacacagcaaaagctaaagctgtataacaagacgccccccaaaggtctagttgtttattgtggaacagtgatcacagaagatggaaaggaaaagaaaatgtccattgattttgaaccattcaggccaataaatacgagtttatatttatgtgacaataagtttcacgtagaggcattaaaagagttattggaaagtgatgacaaatttggatttattatagtagatggtaatggtgcattatttggaacaatacaaggaaacacaagagaagtgattagaagatttaccgttgatttaccaaaaaagcatggaagaggaggacagagtgctttacgttttgctcgtttaagattagaaaaaagacataactatgtaagaaaagtagctgaagttgcaacatctgtatttataacaaatgacaaggtgaatgtaacaggtatcgtgttagcgggtagtgctgattttaaaaatgatttattaaatagtgatatgtttgatcagagattatttgcaaaagttattaagattgttgatatatcatatggtggagataatggatttaaccaagctattgaattaagttctgaagctttacagaatgtgaaatttattcaagagaaaaaattaattggtaaattttttgaagaaatagctcaagatacaggtaaagttgtatatggtatagatgatactttaaaggcattagaaattggagcagtagaattgttaattttatatgaaggtttagatattattagattaactacaaaaaaccctgtaaccaatcaaaccaaaactatgcatatttcgccatgtgatgaaaaacaagaatcattatataaagaaaataatgtggaattagaagtagtagaaaaaatctcgttaactgattgggttattggtaattataaaaaatatggagcttctttagattttgtaacaaacaaatcacaagaaggcgcacaatttcaaaaaggttttggaggttttggtggaatgttaaggtataaaattgatttaaatctttacgatgaggatgttgaaagtgacgtcgaattattttaa

SEQ ID NO: 44 - protein, 427 aa, Plasmodium falciparum
MEDHDANVEQWKIKRLIKKLENAKGNGTSMISLIIKNKDEVSRINKMLADELGTASNIKSRVNRLSVLSAITSTQQKLKLYNKTPPKGLVVYCGTVITEDGKEKKMSIDFEPFRPINTSLYLCDNKFHVEALKELLESDDKFGFIIVDGNGALFGTIQGNTREVIRRFTVDLPKKHGRGGQSALRFARLRLEKRHNYVRKVAEVATSVFITNDKVNVTGIVLAGSADFKNDLLNSDMFDQRLFAKVIKIVDISYGGDNGFNQAIELSSEALQNVKFIQEKKLIGKFFEEIAQDTGKVVYGIDDTLKALEIGAVELLILYEGLDIIRLTTKNPVTNQTKTMHISPCDEKQESLYKENNVELEVVEKISLTDWVIGNYKKYGASLDFVTNKSQEGAQFQKGFGGFGGMLRYKIDLNLYDEDVESDVELF

SEQ ID NO: 45 - DNA, 1317 bp, Drosophila melanogaster
atgtctggcgaggaaacgtctgccgatcgcaatgtcgagatctggaaaatcaagaagctcatcaagagcctggaaatggcccgcggcaatggaaccagcatgatttctttgattattccgccaaaggatcaaatctcgcgcgtcagcaagatgttggccgatgagtttggaacggcgtcgaacatcaagtcgcgtgtaaatcggttgtccgtcctcggtgccattacgtcggtacagcacagactcaaattatacaccaaagtgcctcccaacggtttggtcatctactgcggcacaatagtcacagaggagggcaaggagaagaaggtgaacatagactttgagccattcaagcccataaacacgtcgctctacctctgcgacaacaagttccacacggaggccctcactgccctgctcgccgacgacaacaaatttggattcatcgtgatggatggtaacggagcgctattcggtacccttcagggcaacacgcgcgaggtgctccacaagttcaccgtcgatctgccgaagaagcacggtcgtggtggtcagtccgcccttcgtttcgcccgtctgcgtatggagaagcgccacaactacgtgcggaaggtcgccgaggtggccacccagctcttcatcacgaacgacaagcccaacattgccggactcatcctggctggtagtgcggatttcaagactgagcttagtcagtctgatatgttcgatcctcgtttgcaatcaaaagtcatcaagctggtggacgtgtcgtatggtggggaaaacggttttaaccaggccattgaactggcggccgaatcattgcagaacgttaaattcatacaggagaagaaactcattggtcgctactttgatgaaatttctcaggatactggcaaatactgttttggagtggaggacactttgcgggcactggaacttggctctgtagagactctcatttgttgggagaacctggatattcaacgttatgttctcaagaatcatgccaactcgacgtcaacgacagtattacatttgacgcccgagcaggaaaaggacaagtcgcacttcactgacaaggagagcggggtagaaatggagctgattgagtctcagccgctgctggaatggctggcaaacaactacaaaatgttcggcgccacactggagattatcacggataagtcccaggaaggaagtcagttcgtgcgaggtttcggtggaatcggcggtatcttacgctacaaggtggatttccagagtatgcagctcgatgaattggacaatgatggcttcgatctagatgattactag

SEQ ID NO: 46 - protein, 438 aa, Drosophila melanogaster
MSGEETSADRNVEIWKIKKLIKSLEMARGNGTSMISLIIPPKDQISRVSKMLADEFGTASNIKSRVNRLSVLGAITSVQHRLKLYTKVPPNGLVIYCGTIVTEEGKEKKVNIDFEPFKPINTSLYLCDNKFHTEALTALLADDNKFGFIVMDGNGALFGTLQGNTREVLHKFTVDLPKKHGRGGQSALRFARLRMEKRHNYVRKVAEVATQLFITNDKPNIAGLILAGSADFKTELSQSDMFDPRLQSKVIKLVDVSYGGENGFNQAIELAAESLQNVKFIQEKKLIGRYFDEISQDTGKYCFGVEDTLRALELGSVETLICWENLDIQRYVLKNHANSTSTTVLHLTPEQEKDKSHFTDKESGVEMELIESQPLLEWLANNYKMFGATLEIITDKSQEGSQFVRGFGGIGGILRYKVDFQSMQLDELDNDGFDLDDY

SEQ ID NO: 47 - DNA, 1314 bp, Homo sapiens
atggcggacgaccccagtgctgccgacaggaacgtggagatctggaagatcaagaagctcattaagagcttggaggcggcccgcggcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatctactgaagtcctctccaacgtgaaattcattcaagagaagaaattaataggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaagaggagaaaattctctatctaactccagagcaagaaaaggataaatctcatttcacagacaaagagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtatcttgcggtaccgagtagatttccagggaatggaataccaaggaggagacgatgaattttttgaccttgatgactactag

SEQ ID NO: 48 - protein, 437 aa, Homo sapiens
MADDPSAADRNVEIWKIKKLIKSLEAARGNGTSMISLIIPPKDQISRVAKMLADEFGTASNIKSRVNRLSVLGAITSVQQRLKLYNKVPPNGLVVYCGTIVTEEGKEKKVNIDFEPFKPINTSLYLCDNKFHTEALTALLSDDSKFGFIVIDGSGALFGTLQGNTREVLHKFTVDLPKKHGRGGQSALRFARLRMEKRHNYVRKVAETAVQLFISGDKVNVAGLVLAGSADFKTELSQSDMFDQRLQSKVLKLVDISYGGENGFNQAIELSTEVLSNVKFIQEKKLIGRYFDEISQDTGKYCFGVEDTLKALEMGAVEILIVYENLDIMRYVLHCQGTEEEKILYLTPEQEKDKSHFTDKETGQEHELIESMPLLEWFANNYKKFGATLEIVTDKSQEGSQFVKGFGGIGGILRYRVDFQGMEYQGGDDEFFDLDDY

SEQ ID NO: 49 - DNA, 1395 bp, Aspergillus fumigatus
atgagcgcgcctcagccgaacgaagctgagaagaacattgaaatatggaaggtgaagaagcttatcaagcggcttgaagccgctaggggaaatggaacttcgatgatttctcttatcattccccccaaagatcaagtctcacgagcggcaaagatgttagctgaagaatttggtacggcttctaatatcaaatctcgcgtcaaccgtctctccgttctttcagccatcacttctactcagcaacgtcttaagctgtacaacaaggttcctccaaacggcctagtgatctactgtggtgaaatcatcacgtcagaaggcaaagaacgaaagatcaacattgatttcgagccattcaaacccatcaatacctcgctctatctttgtgacaacaagttccatacagaagctttgagtgagctcctcgagtcagatcagaagttcggcttcattgtcatggatggaaacggcgccctcttcggcaccctgagtggcaatactcgagaagtcattcagaagctaagcgttgacttacccaagaaacacggtcgtggtggccagtctgcgttgcgttttgcccgtctgcgtgaggaaaaacgtcataactatgtgcgcaagattgccgaactggctgtccaaaacttcattacgaacgacaaagtgaacgttgcgggcctgattttagcaggttctgctgatttcaagaatgacctcaaccagtcagatatgttcgatcagcgtctgcaagccaaagtcatcaaagtcgtggatgtctcttacggcggagaaaatgggttcaaccaagctatcgaactctcctcggagactctgagcaatgtcaagtttgttcaagagaaaaagctgattggccagtacttccaggaaatcagccaagatactggaaaggtctgctatggtattgatgacactttgaaggctttggaactcggtgccgcggagactctcatcgtttatgagaacctcgacgtgacccgatatgttctcaaggcgtcaactggctccgaagtcattgtccatgccaccaaagctcaagaagagaaccgagcgttgtttaccgacaaagacactggcactgagatggaagttgttgagcagacttctttcctcgagtggcttgccgagaactacaaagattttggtgctacgttggagtttgtttcagataaatctagcgaaggaaaccagtttgtgaagggttttggtgggattggagcactcttgcggtacaaggtcaactttgaacagcttgctgaccttgatgacgaggatgaattctacgacggtacgtctcgaattctgaaatatcttgtcatgtatgctaacgcaggccatctgtgcagattgacggttctgcggcctcgcagagagcgaggatga

SEQ ID NO: 50 - protein, 464 aa, Aspergillus fumigatus
MSAPQPNEAEKNIEIWKVKKLIKRLEAARGNGTSMISLIIPPKDQVSRAAKMLAEEFGTASNIKSRVNRLSVLSAITSTQQRLKLYNKVPPNGLVIYCGEIITSEGKERKINIDFEPFKPINTSLYLCDNKFHTEALSELLESDQKFGFIVMDGNGALFGTLSGNTREVIQKLSVDLPKKHGRGGQSALRFARLREEKRHNYVRKIAELAVQNFITNDKVNVAGLILAGSADFKNDLNQSDMFDQRLQAKVIKVVDVSYGGENGFNQAIELSSETLSNVKFVQEKKLIGQYFQEISQDTGKVCYGIDDTLKALELGAAETLIVYENLDVTRYVLKASTGSEVIVHATKAQEENRALFTDKDTGTEMEVVEQTSFLEWLAENYKDFGATLEFVSDKSSEGNQFVKGFGGIGALLRYKVNFEQLADLDDEDEFYDGTSRILKYLVMYANAGHLCRLTVLRPRRERG

SEQ ID NO: 51 - DNA, 1317 bp, Candida glabrata
atggatactgacgctgagaagaatattgaaatctggaaggtgaagaagctagttaggtctttggagcaggccagaggtaatggtacttctatgatttctttggttatcccaccaaagggtcaaattccgctagtgcagaaaatgttgactgaagaatatggtactgcttctaacatcaagtctcgtgtgaatcgtctatctgtgttgtctgccattacatctacacaacagaagttgaagctttacaacagtttgccaccaaatggtcttgtgttgtactgtggtgacattattacagaagatggtaaggaaaagaaggttacatttgacattgagccatacaagcctatcaacacatctctatacctgtgtgacaacaagttccacactgaagtgctgtctgaactgttagaggctgatgacaagtttggtttcattgtcatggatggtcaaggtgctctgttcggtctgctgcaaggtaacactagatccgttctacataagtttactgtcgacttgccaaagaagcacggtagaggtggtcaatctgccgtccgtttcgcccgtttgagagaagaaaagagacataactacgttagaaaagtcgctgaagtcgcagtacagaacttcatcactaacgataaagttaacgtaaagggtttaatcttggcaggttccgcagatttcaagaccgacttggctaaatctgaactatttgaccaaagattggccgctaaagttgttcaaatcgtggatatctcctacggtggtgaaaacggtttcaaccaagccattgaattgtccgctgatgctttggccaacgttaagttcgtgcaagaaaagaaactgctggatgaatatttcgacgagatctcccaagatactggtaagttctgttacggtattgacgacaccttgaaagctcttgacctaggtgctgtggaaaagttgattgttttcgaaaacttagagactattagatacactttcaaggattcagaggacaatgaagttattagattcgctgagccaaaggccaaggataagtcatacgctgtggacaaagcgaccggccaagaaatggaagttgttactgaacaacctctaattgaatggttagctgaaaattacaagaacttcggtgctgctctagaattcatcactgataagtctcaagaaggttcccaattcgttactggttttggtggtattggtgctcttctacgttataaggtcaacttcgaacaacttgtcgatgaatcagaagacgagtattatgatgatgatgaagttgagtctgactatgactttatctaa

SEQ ID NO: 52 - protein, 438 aa, Candida glabrata
MDTDAEKNIEIWKVKKLVRSLEQARGNGTSMISLVIPPKGQIPLVQKMLTEEYGTASNIKSRVNRLSVLSAITSTQQKLKLYNSLPPNGLVLYCGDIITEDGKEKKVTFDIEPYKPINTSLYLCDNKFHTEVLSELLEADDKFGFIVMDGQGALFGLLQGNTRSVLHKFTVDLPKKHGRGGQSAVRFARLREEKRHNYVRKVAEVAVQNFITNDKVNVKGLILAGSADFKTDLAKSELFDQRLAAKVVQIVDISYGGENGFNQAIELSADALANVKFVQEKKLLDEYFDEISQDTGKFCYGIDDTLKALDLGAVEKLIVFENLETIRYTFKDSEDNEVIRFAEPKAKDKSYAVDKATGQEMEVVTEQPLIEWLAENYKNFGAALEFITDKSQEGSQFVTGFGGIGALLRYKVNFEQLVDESEDEYYDDDEVESDYDFI

SEQ ID NO: 53 - DNA, 1320 bp, Debaryomyces hansenii
atgtcaagtcaagaagcagacacagctgaaaagaatattgagatctggaaggtcaagaagttgatcaagtctttggaacaagccagaggtaatggtacatcgatgatttcattggttattccaccaaagggtcaagtttcgcttatccagaagatgttgacagaagaatacggtaccgcatccaatatcaagtctcgtgtcaacagattgtcagtgttatcggccatcacatccacacaacaaaaattaaagttatataactcagttccgaaaaacgggttagtcctttactgtggtgatgttttaacggatgaaggtaaggaaaagaagttgaatattgatttcgaaccattcaagccaattaatacatctttgtacttgtgtgacaataagttccacgttgaagcattgtctgaattattagaaaacgacgatagatttggatttattattatggatggtaatggtgcgttatttggtactgtttgtggtaataccagagaagtgttacacaagttttccgttgatttaccaaagaagcatggtagaggtggtcaatcggcgcttcgtttctctcgtttaagagaagaaaaaagacacaattatgtgagaaaagtcgctgaagttgcagttcaaaacttcataagtgctgataaggttactgtcaagggtttgattttggctggttctgcggatttcaaaaccgaattgtcaaaatctgatttattcgataatagattacaagccaaggttatcaagattgtcgatgtttcctatggtggtgaaaatggtttcaaccaagccattgaattatctgctgaaactttggctaatgtcaagtttgtgcaagaaaagaaattgttgaatcaatacttcgacgaaatctctcaagatactggtaaattttgttacggtattgaggataccttgaaagctttggacttaggtgcatgtgaaattatcatcgtttatgaaaatttgaatatcattcgttataccttgaaggatattgaaggtaacgaggttattgctcatgcaaacccagacttaccagataaatcatacatgttagataagaagacaggaactgaaatggagactgttaaagaggaatcgttcttggaatggttagctgaaaactacaaaaattttggtgccaatttagaatttgttaccgatagatcgtccgaaggtgcccaattttgtcaaggttttggtggtattggtgctatgttaagatataaggttaatttcgaacaattagccgatgaatctgatgaggatgaatattatgatgatgatgatgaagacttcctttag

SEQ ID NO: 54 - protein, 439 aa, Debaryomyces hansenii
MSSQEADTAEKNIEIWKVKKLIKSLEQARGNGTSMISLVIPPKGQVSLIQKMLTEEYGTASNIKSRVNRLSVLSAITSTQQKLKLYNSVPKNGLVLYCGDVLTDEGKEKKLNIDFEPFKPINTSLYLCDNKFHVEALSELLENDDRFGFIIMDGNGALFGTVCGNTREVLHKFSVDLPKKHGRGGQSALRFSRLREEKRHNYVRKVAEVAVQNFISADKVTVKGLILAGSADFKTELSKSDLFDNRLQAKVIKIVDVSYGGENGFNQAIELSAETLANVKFVQEKKLLNQYFDEISQDTGKFCYGIEDTLKALDLGACEIIIVYENLNIIRYTLKDIEGNEVIAHANPDLPDKSYMLDKKTGTEMETVKEESFLEWLAENYKNFGANLEFVTDRSSEGAQFCQGFGGIGAMLRYKVNFEQLADESDEDEYYDDDDEDFL

SEQ ID NO: 55 - DNA, 1317 bp, Kluyveromyces lactis
atggagactgatgctgagaagaatattgagatctggaaggtcaagaaattgatcaagtctctagagaaggctaggggtaatggtacctctatgatttcgcttgtcattccaccaaagggtcaaatttctatgattcaaaagatgttgactgatgaatatggtactgcttccaatattaaatcgagagtcaaccgtttgtcagtgctctctgctatcacatccacacaacaaaagctaaaattatacactaagatcccacctaatggtttggtgctatattgtggtgatatgataactgaagaaggtaaagaaaagaaggttacatttgacattgaaccttataaaccaatcaacacctctttgtacttatgtgacaataagttccacacagaggttctttctgaattgctagaagcagatgataaattcggtttcatcgtgatggatggtcaaggtgcattgttcggtcttttgactggtaacacaagaacagttttgcataaattcactgttgatttaccaaagaagcatggtagaggtggtcaatccgctgttcgttttgctcgtttaagagaagaaaagagacataactatgtcagaaaagtggcagaagttgctgtgcaaaattttattacgaacgataaggtgaacgttaaaggtttaatcttggctggttctgcagatttcaaaacagatttggccaaatctgaattgttcgatcaaagattgcaagctaagatcgtcaagatcgttgatatctcatacggtggtgaaaacggtttcaaccaagctatcgaactatctgcagaagccttagccaatgttaaattcattcaagaaaagaaattgattaccgaatatttcgatcaaatctctcaagatactggtaaatactgctacggtatcgaagatactctaaaggctttggatttgggtgctgttgaaattttgattgtttttgaaaatctagaaaccatcagatatgtatacagggactctgaagataaagaagtactaaaattcgtcgaaccagaggaacaagacaaatcatactctcttgataaaactaccggagcagaaatggacttggtctctgaacaaccattaattgaatggcttgcggaaaattacaaaaactacggtgccaatctagaattcattaccgataaatcctctgaaggtgctcaattcgttactggtttcggtggtattggtgcgctacttcgttataaagtcaacttcgaacaattgatggaagattcagatgatgaatattatgatgaaaatgaagatgatgatgactacgatttcatttaa

SEQ ID NO: 56 - protein, 438 aa, Kluyveromyces lactis
METDAEKNIEIWKVKKLIKSLEKARGNGTSMISLVIPPKGQISMIQKMLTDEYGTASNIKSRVNRLSVLSAITSTQQKLKLYTKIPPNGLVLYCGDMITEEGKEKKVTFDIEPYKPINTSLYLCDNKFHTEVLSELLEADDKFGFIVMDGQGALFGLLTGNTRTVLHKFTVDLPKKHGRGGQSAVRFARLREEKRHNYVRKVAEVAVQNFITNDKVNVKGLILAGSADFKTDLAKSELFDQRLQAKIVKIVDISYGGENGFNQAIELSAEALANVKFIQEKKLITEYFDQISQDTGKYCYGIEDTLKALDLGAVEILIVFENLETIRYVYRDSEDKEVLKFVEPEEQDKSYSLDKTTGAEMDLVSEQPLIEWLAENYKNYGANLEFITDKSSEGAQFVTGFGGIGALLRYKVNFEQLMEDSDDEYYDENEDDDDYDFI

SEQ ID NO: 57 - DNA, 1305 bp, Neurospora crassa
atggatcccaacgccaacgaggccgagaagaacattgagatatggaaggtcaagaagctgatcaagcgtcttgaggccgcccgtggaaacggcacctccatgatctcgctcattatcccccccaaggatcagatctccagagccgcaaagatgttggctgaagaatatggcactgcctcgaacatcaagtcgcgtgtcaaccgtcagtccgtcctttcggccattacctccacccagcaaaggctcaagctctataacaaggtgccgcccaatggtcttgtcgtgtactgcggtgaaatcttgacctcagaaggcaaggagagaaaggtcaacatcgacttcgagcccttcaagcccatcaacacctccctctacctttgcgacaacaagttccacaccgaggctcttgccgagcttctcgactccgatcagaagtttggtttcatcatcatggatggtaacggtgctttgttcggcactctcagtggaaacacccgcgatattgtccacaagttttcggtcgatcttcccaagaagcacggtcgtggtggtcagtccgccctgcgttttgcccgtctccgtgaggaaaagcgtcacaactatgtccgcaaggtcgccgaattggctgtccagtgtttcatcaccaacgacaggcctaacgttgccggtctcgttttggctggttccgccgatttcaagaacgacctgaacgcctccgacttgttcgatccccgtctccagaccaaggttgtcaaggttgtcgatgtctcgtatggtggtgaaaacggtttcaaccaggctattgagctgtcctccgagaccctcggaaacgtcaagttcatccaggagaagaagctcatcggcaagtacttcgaggagattagccaggataccggccgcgtctgctacggtattgaggataccctcaaggctttggagctcggtgccgttgaaaccctcatcgtcttcgagaaccttgaggtcaaccgttgggttctcaaggacagcaacggatccgaagtgattctgcatactaccaaggcacaggagcaggccagccgcgacgctttcatggacaaggagacaggccaggagatggaagttgtttcccaggagtccttccttgagtggattgcagaacactacaaggatttcggtgccacgctcgaatttgtctccgatcgctctaccgagggcaaccagtttgtcaagggcttcggtggtatcggcggtatcctccgttacaaagtcaacttcgagcagctagctgacgtcagcgacgatgatgagtactacgacgattga

SEQ ID NO: 58 - protein, 434 aa, Neurospora crassa
MDPNANEAEKNIEIWKVKKLIKRLEAARGNGTSMISLIIPPKDQISRAAKMLAEEYGTASNIKSRVNRQSVLSAITSTQQRLKLYNKVPPNGLVVYCGEILTSEGKERKVNIDFEPFKPINTSLYLCDNKFHTEALAELLDSDQKFGFIIMDGNGALFGTLSGNTRDIVHKFSVDLPKKHGRGGQSALRFARLREEKRHNYVRKVAELAVQCFITNDRPNVAGLVLAGSADFKNDLNASDLFDPRLQTKVVKVVDVSYGGENGFNQAIELSSETLGNVKFIQEKKLIGKYFEEISQDTGRVCYGIEDTLKALELGAVETLIVFENLEVNRWVLKDSNGSEVILHTTKAQEQASRDAFMDKETGQEMEVVSQESFLEWIAEHYKDFGATLEFVSDRSTEGNQFVKGFGGIGGILRYKVNFEQLADVSDDDEYYDD

SEQ ID NO: 59 - DNA, 1017 bp, Saccharomyces cerevisiae
atgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcagaaatgacttcatctgttatatctgtaaaaaatgcctcttctgagtactctgggacatacagctgtacagtcagaaacagagtgggctctgatcagtgcctgttgcgtctaaacgttgtccctccttcaaataaagctggactaattgcaggagccattataggaactttgcttgctctagcgctcattggtcttatcatcttttgctgtcgtaaaaagcgcagagaagaaaaatatgaaaaggaagttcatcacgatatcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaaggtagctgcccctaatctaagtcgaatgggtgcgattcctgtgatgattccagcacagagcaaggatgggtctatagtatag

SEQ ID NO: 60 - protein, 437 aa, Saccharomyces cerevisiae
MDNEVEKNIEIWKVKKLVQSLEKARGNGTSMISLVIPPKGQIPLYQKMLTDEYGTASNIKSRVNRLSVLSAITSTQQKLKLYNTLPKNGLVLYCGDIITEDGKEKKVTFDIEPYKPINTSLYLCDNKFHTEVLSELLQADDKFGFIVMDGQGTLFGSVSGNTRTVLHKFTVDLPKKHGRGGQSALRFARLREEKRHNYVRKVAEVAVQNFITNDKVNVKGLILAGSADFKTDLAKSELFDPRLACKVISIVDVSYGGENGFNQAIELSAEALANVKYVQEKKLLEAYFDEISQDTGKFCYGIDDTLKALDLGAVEKLIVFENLETIRYTFKDAEDNEVIKFAEPEAKDKSFAIDKATGQEMDVVSEEPLIEWLAANYKNFGATLEFITDKSSEGAQFVTGFGGIGAMLRYKVNFEQLVDESEDEYYDEDEGSDYDFI

SEQ ID NO: 61 - DNA, 1299 bp, Yarrowia lipolytica
atggccaaggaagtggaaccaagcgacgccgagaagaacatcgagatctggaaggtgcgaaagctgatcaagaacctcgaggccgctcgaggtaacggaacctccatgatctcgctcatcatgccccccaagacccagattccacagtactccaagatgttgaccgatgagtacggaaccgcctctaacatcaagtctcgagtcaaccgacagtcggtgctctccgctatcacatccactcagcagcgtctcaagctgtacaaccgagtgcccaccaacggtctggttatctactgtggagacgtgattactgccgacggcaaggagaagaagatgtccattgacttcgagcccttcaagcccatcaacacctctctttacctgtgtgacaacaagttccataccgaggctctgtcagagctgctggagtccgactccaagtttggcttcattgtcatggacggtaacggagccctgttcggtactctgtccggaaacacccgagaggttctgcacaagttcaccgttgatctgcccaagaagcatggtcgtggtggtcagtccgcgctgcgattctcccgactgcgagaggaaaagcgacacaactacgtgcgaaaggtggccgaggtggctgtccagaacttcatcacaaacgacaaggtcaacgtcaacggtctgattctggccggttctgccgacttcaagaccgagctgaacggctctgatctctttgacaaccgtctgcacgctaaggtcatcaagactgtcgatgtgtcgtacggaggagagaacggcttcaaccaggccatcgagctgtctgccgagactctgtccaacgtcaagttcgttcaggagaagaagctgctgacccagtacttcgacgagatctccatggactctggaaagttctgttacggctacgacgagactctcaaggccctggatctcggagcctgcgagactgtcattgtctacgagaaccttgacatccagcgaatgactctcaagaacaacgatggcgaggagaccattgtgcacatcaagaagggaactcccaccgaggaatacctgatcgacaaggagggtaacgagctggaggtggtcgacgagattcctctgctcgagtggctagccgagcactacaaggactttggcgcccagctggagtttgtcacagaccggtcctccgagggtgcccagttcgtccagggctttggtggtatcggcgctctgctccggtacaaggtcaactttgagcagctcgtggaggagtctgacgacgagtactacgacgactaa

SEQ ID NO: 62 - protein, 432 aa, Yarrowia lipolytica
MAKEVEPSDAEKNIEIWKVRKLIKNLEAARGNGTSMISLIMPPKTQIPQYSKMLTDEYGTASNIKSRVNRQSVLSAITSTQQRLKLYNRVPTNGLVIYCGDVITADGKEKKMSIDFEPFKPINTSLYLCDNKFHTEALSELLESDSKFGFIVMDGNGALFGTLSGNTREVLHKFTVDLPKKHGRGGQSALRFSRLREEKRHNYVRKVAEVAVQNFITNDKVNVNGLILAGSADFKTELNGSDLFDNRLHAKVIKTVDVSYGGENGFNQAIELSAETLSNVKFVQEKKLLTQYFDEISMDSGKFCYGYDETLKALDLGACETVIVYENLDIQRMTLKNNDGEETIVHIKKGTPTEEYLIDKEGNELEVVDEIPLLEWLAEHYKDFGAQLEFVTDRSSEGAQFVQGFGGIGALLRYKVNFEQLVEESDDEYYDD

SEQ ID NO: 63 - DNA, 1317 bp, Chlamydomonas reinhardtii
atggcggaccaatctgagaccgacaagaacattgagatgtggaagattaagcggctcatcaaggctctggaggctgctcgtggcaacggcaccagcatgatcagcctgatcatgccccccaaggaccaggtcgctcgtgtccagaagatgcttggtgatgagtatggcacggcttccaacatcaagtcgcgtgtgaaccgcctttcagtgctgagcgccatcacatcggcccagcagcgcctgaagctatacaacaaggtgcccccgaacggcctggtcgtctacacgggcaccattatgaccgatgacggcaaggagaagaaggtgaacattgactttgagcccttcaagcccatcaacacgtcgctgtacctgtgcgacaacaagttccacacggaggccctgaacgagctgctggagtctgacaacaagtacggcttcatcatcatggacggtaacggcagcctgttcggcacgctgtgcggcaacacgcgcgaggtgctgcacaagttcacggtggacctgcccaagaagcacggccgtggtggccagtcggcgctacgtttcgcgcgtctgcgtgtggagaagcgccacaactacgtgcgcaaggtggctgagatggcggtgcagttcttcatcaccaacgaccggccgaacgtgtcgggcctggtgctggcgggtagcgccgacttcaagacggagctgtcccagtccgacatcttcgacccgcgcctgcaggcggtggtgctgggcgtggtggatgtgtcgtacggcggtgagaacggcttcaaccaggccattgagctgtcggccgagatgctggccaacgtcaagttcgtgcaggagaagcggctgatcgggcgcttcttcgaggagatcagccaggactccggcaagtttgtcttctcggtcaaggacacgatgcagtgcctggagatgggcgcggtggagatcctgatcgtgtgggagaacctggactgcgaccgctacgagctgatgaacccctccacgcagaaggtggaggtcaagctgctcaacgccgagcaggccaaggacctgtcccacttcaaggacaaggaggcggggtgcgacctggaggtgcaggacaagatgccgctgctggagtggctggccaacaactacaagaagttcggctgcacgctagagttcgtgaccaacaagtcgcaggagggcagccagttctgcagagggttcggaggcatcggcggcatccttcgctaccaggtcaacctggcggagctggatgtggacgaggacgatgccggcgacgcgctctggagcgatgatgacttctaa

SEQ ID NO: 64 - protein, 438 aa, Chlamydomonas reinhardtii
MADQSETDKNIEMWKIKRLIKALEAARGNGTSMISLIMPPKDQVARVQKMLGDEYGTASNIKSRVNRLSVLSAITSAQQRLKLYNKVPPNGLVVYTGTIMTDDGKEKKVNIDFEPFKPINTSLYLCDNKFHTEALNELLESDNKYGFIIMDGNGSLFGTLCGNTREVLHKFTVDLPKKHGRGGQSALRFARLRVEKRHNYVRKVAEMAVQFFITNDRPNVSGLVLAGSADFKTELSQSDIFDPRLQAVVLGVVDVSYGGENGFNQAIELSAEMLANVKFVQEKRLIGRFFEEISQDSGKFVFSVKDTMQCLEMGAVEILIVWENLDCDRYELMNPSTQKVEVKLLNAEQAKDLSHFKDKEAGCDLEVQDKMPLLEWLANNYKKFGCTLEFVTNKSQEGSQFCRGFGGIGGILRYQVNLAELDVDEDDAGDALWSDDDF

SEQ ID NO: 65 - DNA, 1329 bp, Chlorella
atgggggataagacggacgctgaccagcagattgaaatttggaaggtcaagcggctaatcaaagcgctggacaatgcgcgaggcaacggcacctccatgatcagcctcatcatgccgcccaagtcgcaggtggcccagacatcggccatgcttgccaacgagtacggcaccgcctccaacatcaagtcgcgcgtcaaccgccagtcggtgctggccgccatcaccagcgcgcagcagcgcctgaagctgtacacgcgcgtgccgccaaacggcctggtggtgtacacgggcacggtgatgacggacgacggcaaggagaagaagatgaacatcgacttcgagcccttcaagcccattaacacctccctctacctctgcgacaacaagttccacacggaggccctgaacgagctgcttgaggcagacaacaagtatggcttcatcgtcatggacggcaacggcagcctgtttggcacgctgtgcggcaacaaccgcgagatcctgcacaaggtgtctgttgacctccccaagaagcacggccgcggcgggcagtcggcgctgcgctttgcgcgcctgcgcatggagaagcggcacaactacgtccgcaaggtggcggagctggcggtgcagttcttcatcaccaacgaccggcccaacgtggcggggctggtgctggcggggtcggcagacttcaagacggagctgtcgcagagcgacatgtttgacccgcggctgcaggccgtggtgctggcggtggtggatgtgtcgtacggcggagagaacggcttcaaccaggccattgagctgtcggcggagacgctggccaacgtcaagtttgtgcaggagaagcggctgatcagcagcttcttcgaccaaatcagccaggacacgggcaagtttgtgtttggggtgaaggacacgctggcgtgcctggagatgggcgcggtggagacgctgatcgtgtgggagaacctggacatgcagcgatacgagttcacaaacaccacctcaggcgttcaggaggtcaagtacctgaccaaggagcaggagacggagagcaagcacttcaaggaccccgccaccaacatcgacctggaagtgacggacaagcaacccatgctggagtggctggccaacagctacaagaagtttgggtgcctgctggagtttgtgaccgacaggtcggaggagggcaaccagttctgcaagggctttggcggcatcggcggcgtgctgcgctactcggtggacctcacagaatttgaggagccggaggaggatggcggcagcgatggggcgctgtggtccgaggaggaagacttcttctga

SEQ ID NO: 66 - protein, 442 aa, Chlorella
MGDKTDADQQIEIWKVKRLIKALDNARGNGTSMISLIMPPKSQVAQTSAMLANEYGTASNIKSRVNRQSVLAAITSAQQRLKLYTRVPPNGLVVYTGTVMTDDGKEKKMNIDFEPFKPINTSLYLCDNKFHTEALNELLEADNKYGFIVMDGNGSLFGTLCGNNREILHKVSVDLPKKHGRGGQSALRFARLRMEKRHNYVRKVAELAVQFFITNDRPNVAGLVLAGSADFKTELSQSDMFDPRLQAVVLAVVDVSYGGENGFNQAIELSAETLANVKFVQEKRLISSFFDQISQDTGKFVFGVKDTLACLEMGAVETLIVWENLDMQRYEFTNTTSGVQEVKYLTKEQETESKHFKDPATNIDLEVTDKQPMLEWLANSYKKFGCLLEFVTDRSEEGNQFCKGFGGIGGVLRYSVDLTEFEEPEEDGGSDGALWSEEEDFF

SEQ ID NO: 67 - DNA, 1329 bp, Ostreococcus sp. RCC809
atggcggatcacgaggacaatgaaaaggagatcgagatatggaagatgcgcaagctcatcaagaagctcgaagaggcgagagggaacgggacgtctatgatttcgctcgtgatccctccgaaggggcaggtgaacttggtgcaaaagatgttggttgaagaaatgggtacggcgacgaacatcaagtcccgagtgaaccgtcagtcagtgctagatgcgatcggttcggcgcaacagcgattgaagctttacagcaaggtgccgccgaacggtttggtcgtgtattgcggagcggtgttgacggagagcgggaaggagcgtcaaatgaggattgattttgagccgttcaagccgatcaacacttcgctttacatgtgtgataacaagttccacacggcagcgttgagcgatctcttggttaacgaccaaaagtacggcttcgtcgtcatggatggtaacggaacgctcttcgggacgctttgcggtaaccatcgcgaagttttgcaaaagatttctgttgatttgccgaagaagcacggtagaggtggtcagtccgcgcttcgtttcgcgcgtttgcgtttagaaaagcgtcaaaactatctcacaaaggttgccgagctcacgacgcagcactttatcaccaacgacaaacccaacgtcgcgggtttggttctcgcgggttccgcggatttcaagaacaagctcgccgaggcggattgctttgataatcgtttgcaagaagtgactttggcggtggttgatgtgtcttacggtggtgaaaacggcttcaaccaagccatcgagttgtcggctgacaccttgtcttcgctcaagtttatcgccgagaagaagttggttggtaaattctttgacgaaatcgcgcaagataccggcaagtatgtgttcggtatcaacgacacgttggcgtgcttggagatgggcgcagtggagactttggttgcctgggaagatctcgaggtgaagcgcgtcacgcttaagaacccgaccacggaggaagagattgtcaagcacttgcgacaggaggaaatcgaaggcaacgacaacgaacacgttcgcgacgaggaaggcaacgatttggagattgtcgattctgtcccgctcctcgagtggttggccaccgagtacaaaaagtttggttgcgttctcgagcttatctcggacaagtcgcaagaaggaaaccagttttgcagaggctttggaggcatcggcggtttgttgcgataccaagtcgatctcaccgcgttcgaaatcgccgccgacgccgactccgacgactgggactccgatgactcggaatgcttcatttaa

SEQ ID NO: 68 - protein, 442 aa, Ostreococcus sp. RCC809
MADHEDNEKEIEIWKMRKLIKKLEEARGNGTSMISLVIPPKGQVNLVQKMLVEEMGTATNIKSRVNRQSVLDAIGSAQQRLKLYSKVPPNGLVVYCGAVLTESGKERQMRIDFEPFKPINTSLYMCDNKFHTAALSDLLVNDQKYGFVVMDGNGTLFGTLCGNHREVLQKISVDLPKKHGRGGQSALRFARLRLEKRQNYLTKVAELTTQHFITNDKPNVAGLVLAGSADFKNKLAEADCFDNRLQEVTLAVVDVSYGGENGFNQAIELSADTLSSLKFIAEKKLVGKFFDEIAQDTGKYVFGINDTLACLEMGAVETLVAWEDLEVKRVTLKNPTTEEEIVKHLRQEEIEGNDNEHVRDEEGNDLEIVDSVPLLEWLATEYKKFGCVLELISDKSQEGNQFCRGFGGIGGLLRYQVDLTAFEIAADADSDDWDSDDSECFI

SEQ ID NO: 69 - DNA, 1362 bp, Leishmania braziliensis
atgtccggcgagaaggagctgacagatgcagagaagaccattgagcggtacaaggtcaagaaactcattcagatgctcgaatccgcgcgtgggatggggacgagcgtgatcagcgtgtacatgacaccaaaggagcagatttccggcatggtggcgaagctgaacaatgagtatggcacggcatcgaacatcaagtctcacacaaacaagttgagcgtgcagagcgccatcacggcagccctcggacgcctcaagcagattccgcgtgtgccgacgaatggcctgctgctgtactctggcaccgtgatgacggccgacaacaaggagaagaagctgacgcttgacattgagccctttaaggccgtcagtcgcagcctttacctgtgcgacaacaagttccacacggaagagctgcgccgaatgctcgagtcggacgacaagttcggcttcattatcatggacggtagcggctgcacctttgcgacggtgtgcggcgatgtcaaggagaaactcggctccttcacggtggagctaccgaagaagcacggccgtggtggtcagagtaagaaccgtttcgcgcgtatacggatggagcggcgccacaactacgtacgcaaggtggccgagtcggcggtcagctacttcatcacgaacgatcgcccaaacgtgcgcggtctcgtgctcgcgggttcggccgacttcaaggaggtgctcttccagtccgacctatttgacccccgcctaaaggaggtagtggtgaagatcgtcgatgttgcccacccgggtgacgtggggctgaaccaggccattgacctctccgccgacgccttgtcgggcgttaagctggtgcaggagaagaagctgctgcagacgttcttcgaccagattgcgatggacacgcagcagtactgcttcggtgtaaacgacgcgatgcgctgcctggaggcgggtgctgtagagacgctcatctgtttcgaggacctcgatgtgaaccgctacgttatcatcaagaacaagggcgctgaggacgaggcgaccgaaatccacctgctgaccgaagcggacgcacgcaagaaaaacatccacgcccacgaagctggcaagacgcagaacgaaatcgagtcggaaaactttgtggactggcttgcacaaaactatcaaaagtttggttgcactctagagctcatcagcgaccgcagccaggaaggcacacagctcgtgcgcggcttcggtggcattggcggcattctgcgctacaagatggacgtaatagctctccgagaccacgagaaaaaggagggcgaagatgaacgtattgccgcgaacaacgaccagtttgactttgacgacgatttcatgtga

SEQ ID NO: 70 - protein, 453 aa, Leishmania braziliensis
MSGEKELTDAEKTIERYKVKKLIQMLESARGMGTSVISVYMTPKEQISGMVAKLNNEYGTASNIKSHTNKLSVQSAITAALGRLKQIPRVPTNGLLLYSGTVMTADNKEKKLTLDIEPFKAVSRSLYLCDNKFHTEELRRMLESDDKFGFIIMDGSGCTFATVCGDVKEKLGSFTVELPKKHGRGGQSKNRFARIRMERRHNYVRKVAESAVSYFITNDRPNVRGLVLAGSADFKEVLFQSDLFDPRLKEVVVKIVDVAHPGDVGLNQAIDLSADALSGVKLVQEKKLLQTFFDQIAMDTQQYCFGVNDAMRCLEAGAVETLICFEDLDVNRYVIIKNKGAEDEATEIHLLTEADARKKNIHAHEAGKTQNEIESENFVDWLAQNYQKFGCTLELISDRSQEGTQLVRGFGGIGGILRYKMDVIALRDHEKKEGEDERIAANNDQFDFDDDFM

SEQ ID NO: 71 - DNA, 1359 bp, Trypanosoma brucei
atggccgaccacgagttgtccgagtccgagaaggcaattgaacgatataaggtgaagaagctcatccaaatgctcgagagtgctcgcggtatgggcacaagcgtcataagcatttacatgaccccaaaggagcagatatctggcatggtaaccaaactgaacaacgagtacggaacggcctccaacatcaaatcgcacaccaacaagcttagcgttcaaagtgccatcactgcctctctcggtaggttaaagcagtacaaccgactcccacctaatgggctcctcctctactgcggtaccgtcctcacggcagaaaacaaggagaaaaaacttacacttgatattgagcctttcaagccggttagccggagcctatacctctgtgacaacaagttccacaccgaagagctccaccgcatgctggagtctgatgagaagtttggattcattgttgtagacggtagtggcacaacctatgcaactctttgtgggagtgtgaaggagaagctgagttcattcaccgtagagctaccgaaaaagcacggaagaggtggtcaaagtaaaaatcgtttcgcacgtattcgtatggaaaggcgccacaactaccttcgcaaggtggccgaaggcgccacgcaattatttataacaaacgaccgtccaaatatcgtggggctcgtgcttgccggttctgctgagttcaaggaagtgttgtaccagtcagatctgtttgatccgcgcctgaaagcgatcgtggtgaaggttgtagatgttgcccacccgggcgatgtgggcctcaatcaggccatagatctcgcggcggatgcgctgtctggagttaagctcgtacaagagaagaaactacttcagggattcttcgatcagatcgcttgtgatacgcagctgtattgctttggtgttcaggataccctgaagtgcttggaggcgggcgcggtggaaacacttattgtgtatgaagaccttaacatttaccgctacactgttgtgaagaatcgcggagcagacgatgaggaaaccttcgtccatgttatgtcggaggaagaagcaaagaggtctaatatacacatgcaggagtccgggaagacacgcaatgaaattgaacaggaagactttgtcgactggctcgcgacaaactaccgcaagtttggttgcgccttggagttgatcacgaatcgcagccaggagggaactcaattcgtccgcggttttggagggattggaggtgtgttgcggtataaacttgatattattgctttgcgtgatgtggagaaaaaagaagatgatgaggagcgcattgcagcgaacaatgaggagtttgacttcgacgacgactttatgtaa

SEQ ID NO: 72 - protein, 452 aa, Trypanosoma brucei
MADHELSESEKAIERYKVKKLIQMLESARGMGTSVISIYMTPKEQISGMVTKLNNEYGTASNIKSHTNKLSVQSAITASLGRLKQYNRLPPNGLLLYCGTVLTAENKEKKLTLDIEPFKPVSRSLYLCDNKFHTEELHRMLESDEKFGFIVVDGSGTTYATLCGSVKEKLSSFTVELPKKHGRGGQSKNRFARIRMERRHNYLRKVAEGATQLFITNDRPNIVGLVLAGSAEFKEVLYQSDLFDPRLKAIVVKVVDVAHPGDVGLNQAIDLAADALSGVKLVQEKKLLQGFFDQIACDTQLYCFGVQDTLKCLEAGAVETLIVYEDLNIYRYTVVKNRGADDEETFVHVMSEEEAKRSNIHMQESGKTRNEIEQEDFVDWLATNYRKFGCALELITNRSQEGTQFVRGFGGIGGVLRYKLDIIALRDVEKKEDDEERIAANNEEFDFDDDFM

SEQ ID NO: 73 - protein, 3 aa, Artificial sequence
  GGQ domain
GGQ

SEQ ID NO: 74 - protein, 4 aa, Artificial sequence
  NIKS domain
NIKS

SEQ ID NO: 75 - protein, 5 aa, Artificial sequence
  GILRY domain
  VARIANT (1)..(1): / replace = "Ala"
  VARIANT (2)..(2): / replace = "Met" / replace = "Leu" / replace = "Val"
  VARIANT (5)..(5): / replace = "Trp"
GILRY

SEQ ID NO: 76 - protein, 50 aa, Artificial sequence
  motif 1
  VARIANT (16)..(16): / replace = "Ser"
  VARIANT (48)..(48): / replace = "Val"
FGTLSGNTREVLHKFTVDLPKKHGRGGQSALRFARLRMEKRHNYVRKTAE

SEQ ID NO: 77 - protein, 50 aa, Artificial sequence
  motif 2
  VARIANT (3)..(3): / replace = "Arg"
  VARIANT (13)..(13): / replace = "Cys"
  VARIANT (16)..(16): / replace = "Val"
  VARIANT (19)..(19): / replace = "Asp"
  VARIANT (20)..(20): / replace = "Glu"
  VARIANT (27)..(27): / replace = "Asn"
  VARIANT (34)..(34): / replace = "Arg"
  VARIANT (38)..(38): / replace = "Thr"
YNKVPPNGLVLYTGTIVTEDGKEKKVTIDFEPFKPINASLYLCDNKFHTE

SEQ ID NO: 78 - protein, 50 aa, Artificial sequence
  motif 3
ARGNGTSMISLIMPPRDQISRVTKMLGDEYGTASNIKSRVNRQSVLGAIT

SEQ ID NO: 79 - protein, 50 aa, Artificial sequence
  motif 4
  VARIANT (2)..(2): / replace = "Ser"
  VARIANT (24)..(24): / replace = "Met"
  VARIANT (37)..(37): / replace = "Leu"
  VARIANT (39)..(39): / replace = "Thr"
  VARIANT (47)..(47): / replace = "Arg"
  VARIANT (48)..(48): / replace = "Val"
FTVDLPKKHGRGGQSALRFARLREEKRHNYVRKVAEVAVQNFITNDKPNV

SEQ ID NO: 80 - protein, 50 aa, Artificial sequence
  motif 5
  VARIANT (2)..(2): / replace = "Thr"
  VARIANT (3)..(3): / replace = "Arg"
  VARIANT (11)..(11): / replace = "Leu" / replace = "Ile"
  VARIANT (15)..(15): / replace = "Asp"
  VARIANT (16)..(16): / replace = "Val"
  VARIANT (17)..(17): / replace = "Leu" / replace = "Met"
  VARIANT (19)..(20): / replace = "Asp"
  VARIANT (24)..(24): / replace = "Arg"
  VARIANT (26)..(26): / replace = "Met"
  VARIANT (27)..(27): / replace = "Thr"
  VARIANT (30)..(30): / replace = "Ile"
YNKVPPNGLVVYCGTIITEEGKEKKVNIDFEPFKPINTSLYLCDNKFHTE

SEQ ID NO: 81 - protein, 50 aa, Artificial sequence
  motif 6
  VARIANT (12)..(12): / replace = "Val"
  VARIANT (13)..(13): / replace = "Met"
  VARIANT (17)..(17): / replace = "Gly"
  VARIANT (19)..(19): / replace = "Val"
  VARIANT (21)..(21): / replace = "Leu"
  VARIANT (23)..(23): / replace = "Ala"
  VARIANT (27)..(27): / replace = "Thr"
  VARIANT (28)..(28): / replace = "Glu"
  VARIANT (43)..(43): / replace = "Gln"
  VARIANT (47)..(47): / replace = "Gly"
ARGNGTSMISLIIPPKDQISRVQKMLADEYGTASNIKSRVNRLSVLSAIT

SEQ ID NO: 82 - protein, 50 aa, Artificial sequence
  motif 7
  VARIANT (40)..(40): / replace = "Phe"
VDLPKKHGRGGQSALRFARLRMEKRHNYVRKTAELATQFYINPATSQPNV

SEQ ID NO: 83 - protein, 50 aa, Artificial sequence; identical to SEQ ID NO: 77
  motif 8
  VARIANT (19)..(19): / replace = "Asp"
  VARIANT (34)..(34): / replace = "Arg"

SEQ ID NO: 84 - protein, 50 aa, Artificial sequence
  motif 9
  VARIANT (14)..(14): / replace = "Ile"
  VARIANT (25)..(25): / replace = "Tyr"
TSMISLIMPPRDQVSRVTKMLGDEFGTASNIKSRVNRQSVLGAITSAQQR

SEQ ID NO: 85 - DNA, 2194 bp, Oryza sativa
aatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctccttctcccatctataaattcctccccccttttcccctctctatataggaggcatccaagccaagaagagggagagcaccaaggacacgcgactagcagaagccgagcgaccgccttctcgatccatatcttccggtcgagttcttggtcgatctcttccctcctccacctcctcctcacagggtatgtgcctcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggatcggaatcttgcgattttgtgagtaccttttgtttgaggtaaaatcagagcaccggtgattttgcttggtgtaataaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatgcattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagttc

SEQ ID NO: 86 - DNA, 56 bp, Artificial sequence
  primer: prm09556
ggggacaagtttgtacaaaaaagcaggcttaaacaatgggagacaaaaacgatgac

SEQ ID NO: 87 - DNA, 50 bp, Artificial sequence
  primer: prm09557
ggggaccactttgtacaagaaagctgggttttgattgattgtcattccga

SEQ ID NO: 88 - DNA, 1273 bp, Arabidopsis thaliana
tgggagagaaaaagaagaaaaagagagtccaaccatatcagtttgctttcacagtggagtcggtgctctctttttttttcttctctctttcttttcacctctcgccggatcccggcgatcttataggaggcaaatctatcagtatcgttattctaggatctctaacaaacaatgaatcgccaccacgatcccaatcctttcgatgaggacgaagaaatcgtcaatcctttttcgaaaggtggtggaagggttcctgctgcatctaggccagttgaatatggtcaaagccttgatgctactgttgatattccattggataatatgaatgactcttcacagaaacagagaaagcttgctgactgggaagctgagctcaggaagaaagaaatggatataaagcgaagagaggaagctattgctaaatttggtgtgcagatagatgataaaaactggccaccgtttttcccaatcatacaccatgacattgctaaagagataccagttcatgcacaaaagctgcagtatctggctttcgctagttggttaggtatcgttctgtgtctggtattcaatgtcattgcaacgatggtctgctggattaaaggcggaggtgttaaaatctttttcctggccacaatatatgcattgatcggatgtccactctcttatgtactatggtacaggccactctaccgagccatgaggactgacagtgctttgaagtttggttggtttttcttcacctacttgattcacattggcttctgcatcgttgctgccatcgcccctccaatctttttccatggaaaatcattaacgggtgtgcttgcagcaattgatgtcatctcagacagtttattagctgggatcttctactttatcggattcggtctcttctgcttggagtcactgctgagtctatgggttcttcagaaaatttacctctactttaggggaaacaagtgaaaaggagataaagaggaagatgatggtaattttcccttacgatataaggtctgaaatatgtgtatctcctatgaatgtaattaccattttaccgtttgatgcgttgtgttgattgaggtaaattctttagttactatagtagcaagagagagtggttgttcggccatttctttatgttttttactctgttcttctctggtctgtaatataccaatatcgtctcttagcttttgggattttttttcggcgaagtggatggactatttagacaaaaaaaaatcatagctatgaattattagtagcgact

SEQ ID NO: 89 - protein, 264 aa, Arabidopsis thaliana
MNRHHDPNPFDEDEEIVNPFSKGGGRVPAASRPVEYGQSLDATVDIPLDNMNDSSQKQRKLADWEAELRKKEMDIKRREEAIAKFGVQIDDKNWPPFFPIIHHDIAKEIPVHAQKLQYLAFASWLGIVLCLVFNVIATMVCWIKGGGVKIFFLATIYALIGCPLSYVLWYRPLYRAMRTDSALKFGWFFFTYLIHIGFCIVAAIAPPIFFHGKSLTGVLAAIDVISDSLLAGIFYFIGFGLFCLESLLSLWVLQKIYLYFRGNK

SEQ ID NO: 90 - DNA, 1258 bp, Arabidopsis thaliana
taaaatgccttcgatttctctggcgccattgatttagttttctctctctgactacaaagtatccattcgttcaaaccagtttcttcccattttcgatttctgtcaaaattcaccaaccaactccaaaaactctgttattgaataagtttcttgatcttaaaacaaacgatctcaaagaatggcacgacacgatcctaatccatttgctgatgaagagatcaatccttttgcgaatcatacaagtgttcctcctgcgagcaactcttatctcaagccacttccaccggaaccttatgatcgtggtgcaaccgttgatatccctttggattctggcaatgatcttcgagctaaagagatggaactccaggccaaggagaacgaattgaagcggaaagagcaggagcttaaaagaagagaggacgcaatagcacgaactggagttgtcattgaagagaagaattggccggagttttttcctttaattcatcatgacattccaaatgagattccaattcatttacagaagatccaatacgtcgcattcaccacattgttagggttagtaggatgtctcttgtggaatattgtggcagtaactgtagcttggatcaaaggagaaggtcccactatatggcttctctcaataatttacttccttgctggggtacctggagcgtacgtcttatggtaccgtcctctttaccgagctacaagaactgatagtgccctgaagtttggagcttttttctttttttacgtgttccacatcgcgttctgcggctttgctgcagttgctccaccagtcatcttccaaggaaagtctctcacaggtttcttgccagcaatcgagcttctaactactaatgctgcagtcgggataatgtatttcattggtgctgggttcttctgcatcgaaacacttctcaatatctgggtcattcagcaagtatatgcatacttccgagggagtggcaaagctgcagagatgaagcgtgaagctacaaaatcgaccttgatgcgtgcactatgaagaaatcactcttcaccagaaaagtatcagtggctgcttgaggttaaaatcttgaatcatacacaaaatatttgacacaaccctttcctctgcaaagtctaggctgccaactctcttttgtttgaattactttgtaatggagacctcaaggaaactttgtgtggtttaaagttgtcaacaccatttcttcatgtatactagagcaaggtccttagagggatacgaatc

SEQ ID NO: 91 - protein, 283 aa, Arabidopsis thaliana
MARHDPNPFADEEINPFANHTSVPPASNSYLKPLPPEPYDRGATVDIPLDSGNDLRAKEMELQAKENELKRKEQELKRREDAIARTGVVIEEKNWPEFFPLIHHDIPNEIPIHLQKIQYVAFTTLLGLVGCLLWNIVAVTVAWIKGEGPTIWLLSIIYFLAGVPGAYVLWYRPLYRATRTDSALKFGAFFFFYVFHIAFCGFAAVAPPVIFQGKSLTGFLPAIELLTTNAAVGIMYFIGAGFFCIETLLNIWVIQQVYAYFRGSGKAAEMKREATKSTLMRAL

SEQ ID NO: 92 - DNA, 1145 bp, Arabidopsis thaliana
cagaattgaaggtttgatctttgttgtgaaatcgagagataagctttggtaaaccatgggtggtcgttacgatcggaacacattcgacgaacaagacgaagtcaatccttttgctaatcctgggagtgttcctgctgcttcgaattccagactatcgcctttgcctcccgaacctgctggttttggttatggtcgtactgttgacattcctcttgacagaccagggtctggtgcacaggatttgaaaaagaaagagaaggagctccaagccaaagaagctgacctaagacgacgagagcaagatcttaaacgaaaacaggatgctgctgcccgagccggaattgttatcgaggcaaaaaactggcctaccttcttcccccttatccaccatgacattgcaaatgaaattctggttcgtctccaaaggctacagtatattgcatttgcaacatatttggggttggttctcgcacttttctggaatatcatcgccgttactaccgcttggatcaaaggagaaggagtaacaatttggcttctcgccgttatttacttcatatcgggtgttccaggaggctatgtgttatggtatcggcctctctaccgtgccttcagaagtgatagtgcattcaactttggatggtttttcttgttctacatgctccacatacttttctgcctctttgctgcagttgctcctcctattgtcttcaaaggaaaatcacttgcgggcatattacctgcaatagatgtgttgagcgctcaggcattggtcgggatcttctacttcattgggtttgggttattctgtcttgaatcagtggttagcatctgggttatacagcaagtatacatgtacttcagaggaagcggaaaagcggatgatatgagacgggatgctgcaagaggagccatgagagctgccatatgaggcaaatgtaaatcaatgagtctagtcatctcttcttaagccattgcttgtgatgtgtaatgttttacactatttttcagttgttatttagcttcactgatcgattttttttcttgaacttttatttttattttcgtcagctgttattaaaagtagtaaaagtaaagctcatgtataaaaaattgaattcaatttagttaaaaacttgcaaact

SEQ ID NO: 93 - protein, 291 aa, Arabidopsis thaliana
MGGRYDRNTFDEQDEVNPFANPGSVPAASNSRLSPLPPEPAGFGYGRTVDIPLDRPGSGAQDLKKKEKELQAKEADLRRREQDLKRKQDAAARAGIVIEAKNWPTFFPLIHHDIANEILVRLQRLQYIAFATYLGLVLALFWNIIAVTTAWIKGEGVTIWLLAVIYFISGVPGGYVLWYRPLYRAFRSDSAFNFGWFFLFYMLHILFCLFAAVAPPIVFKGKSLAGILPAIDVLSAQALVGIFYFIGFGLFCLESVVSIWVIQQVYMYFRGSGKADDMRRDAARGAMRAAI

SEQ ID NO: 94 - DNA, 706 bp, Allium cepa
cgaggacaactgcggtctaatcgtgttatttcctttcgtcatttccaagtcttccgaaatccgaatagcaagtttctcgtgatattagtttccccggatttagcgaaaatatcaaaaattatacaaaaatgcaacgcgatccaaatccattcgatgaagatcacgtcaatccatttgcgaaatcagcagattcaagttccaaacctcgttttccgggactttcgtctttaccatttggatttggtaacaagaatgatgctacagatgacattccacttgggtcaatgaatggatcaaaaagtagcgatcttgcttcttgggaagctgatttaaggcgcagagaacaggaaatcagaagaagagaggaggctttaagcaatgctggtgttcctgttgaggagaaaaattggcctccattttttccaatcattcatcacgatatctctaaggaaataccaattcatgctcagcgtttgcagtatttggcttttgcaagttggttgggcatcttgatctgtctggtgtggaatgtgattgctataactgtttgttggaaaaaggggtggaggttgctaaggatttttctgctcgcatgcatatatgctattacttgggatgtccactgtcatatgtgctttggtacaggcctctgtatcgtgcaatgaggacagatagtgcaattaaagtttggattggtcttccttgt

SEQ ID NO: 95 - protein, 178 aa, Allium cepa
MQRDPNPFDEDHVNPFAKSADSSSKPRFPGLSSLPFGFGNKNDATDDIPLGSMNGSKSSDLASWEADLRRREQEIRRREEALSNAGVPVEEKNWPPFFPIIHHDISKEIPIHAQRLQYLAFASWLGILICLVWNVIAITVCWKKGWRLLRIFLLACIYAITWDVHCHMCFGTGLCIVQ

SEQ ID NO: 96 - DNA, 1247 bp, Arabidopsis thaliana
atataagcttgtcttcaacgttcggctaatccttggtccgtgctaagatcttagatcgatttctaaagtcttcgtcttcttcttcttctgataactagctttttcaatcttctgaagctttaattttttcatacccatggctaatcgttatgatccaaatcctttcgctgaggaagaagaagtcaatcctttcgctaatgctagaggagttccacctgcgtcgaattcgagactttcgcctttgcctccagagcctgttggtttcgattatggtcgaaccgtagacattcctcttgacagagctggtacacaggatttgaagaagaaagagaaggaactccaagccaaagaagctgagctaaaacgacgagagcaggacctcaaacggaaagaagatgctgctgcacgagctggaatcgttattgaagtgaaaaactggccgcctttcttcccacttatccaccatgacatcgcaaacgaaattccggttcatctccaaagactacagtatgttacctttgcaacgtatttggggttggttctttgtcttttctggaatatcatcgccgttactacagcttggatcaaaggagaaggagtgacgatatggcttcttgccttaatttacttcatagcgggtgttccaggaggctatgtgttatggtatcgaccactctaccgtgccttcagaactgatagtgcattgagctttggatggtttttcttgttctatatgctccacattgctttctgcgtctttgctgcagttgctccacctgtcgtcttcaaaggaaaatctcttgctgggatcttacctgcaatagatgtcttaagtggtcaagcaattgttgggatattctacttcattgggtttgcatttttctgcctcgaatcagtggttagcatctgggttattcagcaagtgtatatgtacttccgaggcagcgggaaacaagatcaaatgagacgggaagcagcgagaggagccttgagagccgctgtttgagagttctccttgtaacattctggtttgtgtatgcactgtttcttttttcagattttcttgaagtctctctctctctctctctctctctctgctctataaacaaaaaaaaaaagatttaatttttcctttgtacctttatgtcatgtaaatttgtttgttcaaaaatcagagttcagattcatacgtattttgaaatcattcatgaatttttactttttttataagaactcatcttacatcc

SEQ ID NO: 97 - protein, 289 aa, Arabidopsis thaliana
MANRYDPNPFAEEEEVNPFANARGVPPASNSRLSPLPPEPVGFDYGRTVDIPLDRAGTQDLKKKEKELQAKEAELKRREQDLKRKEDAAARAGIVIEVKNWPPFFPLIHHDIANEIPVHLQRLQYVTFATYLGLVLCLFWNIIAVTTAWIKGEGVTIWLLALIYFIAGVPGGYVLWYRPLYRAFRTDSALSFGWFFLFYMLHIAFCVFAAVAPPVVFKGKSLAGILPAIDVLSGQAIVGIFYFIGFAFFCLESVVSIWVIQQVYMYFRGSGKQDQMRREAARGALRAAV

SEQ ID NO: 98 - DNA, 1147 bp, Arabidopsis thaliana
atctccaatcgctctctctctctctctctctctctcgctcggtgtgatccgtgtagagagattggatttgctgagtaacggtgcaatgtctcgctaccagtctcattcctttgatgacggagaaattaatccttttgcgaatcctacaagtgtcccagctgcaacgtcaaagctttctcctcttccccctgagccgtacgaccgtggtgccacaatggatattcctcttgactctggaaaggatctgaaagctaaggagaaggaactccgggaaaaggaggctgaattgaagaggcgggagcaggaaatcaagcggaaagaagatgctatagcacaggccggaattgtgatagaagagaaaaactggccaccgttttttcctctcatccatcatgacatttcaaatgagatacccatccatctgcagagaatccaatatgttgctttcacatcaatgctgggtcttgtggtgtgcctgttatggaacattgtcgcagttactactgcgtggattaagggagaaggtccaacaatatggtttctagctattatctatttcatatcaggggttcctggagcgtatgttatgtggtatcgccctctttatcgtgccatgaggactgatagtgctctgaagtttgggtggtttttcttcacgtatctgtttcacatagcgttttgtgtgtttgcggcggtggctcctccaattatcttcaagggaaaatcgctgacaggaatattgccggcgatcgacgtattgagtgggaatatcttggtcgggatattttacttcattgggtttgggttcttctgtctggagtcactcgtcagcatctgggttattcagcaagtgtacatgtacttcagggggagcgggaaagcagcagagatgaagcaggaggccacaagacgagcaatgatggcagctctctgaccaatgaccacatacacacaccttttaacccatctccaattttttcccatttaacatacaaacaaacagtgaacgttagatcctcttgaaggggattgattatactccgctactcacttcatttttgttttcctcccgatttcatttaactaagattccagtgaactcaacttcttacttttttttggtaaaaggtgaagtcaacttcttact

SEQ ID NO: 99 - protein, 282 aa, Arabidopsis thaliana
MSRYQSHSFDDGEINPFANPTSVPAATSKLSPLPPEPYDRGATMDIPLDSGKDLKAKEKELREKEAELKRREQEIKRKEDAIAQAGIVIEEKNWPPFFPLIHHDISNEIPIHLQRIQYVAFTSMLGLVVCLLWNIVAVTTAWIKGEGPTIWFLAIIYFISGVPGAYVMWYRPLYRAMRTDSALKFGWFFFTYLFHIAFCVFAAVAPPIIFKGKSLTGILPAIDVLSGNILVGIFYFIGFGFFCLESLVSIWVIQQVYMYFRGSGKAAEMKQEATRRAMMAAL

SEQ ID NO: 100 - DNA, 1001 bp, Brassica napus
atggctaaccgctatgatccgaacccatggggtgttgttgaagaagtctattgtttcgctaaagaagggagtgttccagctgcatcgaactcaagactctcgcctttgcctccagaccctgttggtttcgactatggtcgaaccgttgacattcctcttggcaatgacagatccggtacacagaatttgaagaagaaagaaaaggaacttcaagccaaagaagctgacctaagacgacgggagcaggaggtgaaacggagagaagatgctgctgcacgagctggaatcactactgaagtgaaaaactggccgccattcttcccacttatccaccatgacattgccaatgagatccccgttcatctccaaaggctacagtatgttacctttgctacttatttggggttggtcctttgtctattctggaatattattgccattactacagcttggatcaaaggagaaggagtgacgatatggcttcttgccctcatttacttcatagcgggtgtcccaggaggctatgtgttatggtatcgccctctataccgtgccttcagaactgatagtgctttgagctttggatggtttttcctgttctatatgcttcacattcttttcactgtctttgctgcggttgctccacctgttgtcttcaaaggaaaatctcttgctggtatcttacctgcaatagatgtcataagtggtaacacattggttgggatattctacttcattggttttgggtttttctgccttgaatcagtggtcagcatctgggttattcagcaagtgtatatgtacttccgtggcagcgggaaacaagatgagttgagacgagaagcggcgagaggagccctgagagctgccgtgtgagagcttttactgtaacacttggtttgtatgtaattttcactgtttctttcgtttttagattctgtcttcacgtctctctctgctttgtaagcaaaaaaatggattcaatttttcgtgatacgttt

SEQ ID NO: 101 - protein, 291 aa, Brassica napus
MANRYDPNPWGVVEEVYCFAKEGSVPAASNSRLSPLPPDPVGFDYGRTVDIPLGNDRSGTQNLKKKEKELQAKEADLRRREQEVKRREDAAARAGITTEVKNWPPFFPLIHHDIANEIPVHLQRLQYVTFATYLGLVLCLFWNIIAITTAWIKGEGVTIWLLALIYFIAGVPGGYVLWYRPLYRAFRTDSALSFGWFFLFYMLHILFTVFAAVAPPVVFKGKSLAGILPAIDVISGNTLVGIFYFIGFGFFCLESVVSIWVIQQVYMYFRGSGKQDELRREAARGALRAAV

SEQ ID NO: 102 - DNA, 1035 bp, Brassica napus
cgtctctgtagattggatctgctgagtagggtggtgcaatgtctcgctacgagtctccttcctttgacgacggcgaggttaatccttttgcgaatccttcaactgttcctgctgcaacgtcacagtatgaccgtggtggtgccacaactgacatccctctagactctgctgggaaggatctgaaagctaaggagaaggaactccaggccaaagaatctgaattgaagagacgggagcaggaactcaagcggaaagaggatgctatagcacaggccgggattgtgatagaagacaaaaactggccaccgtttttccctctcatccaccatgacatctctaatgagatacccatccatctgcagagaatccaatatgttgcattcacatcgttgctgggtcttgtggtgtgcctgttatggaacattgtggcagtcaccaccgcgtggattaagggagaaggtccaacgatatggtttctagctattatctatttcatatcaggggttcctggagcatatgttatgtggtatcgacctctatatcgtgccatgaggactgatagtgctctgaagtttgggtggtttttcttcacttatctgtttcacatagggttttgtgtattcgccgcggaggctcctccaatcatcttcaaggggaaatcgctgacgggaatattgccggcgattgacgtgttgagcgggaatatattggttgggattttctatttcattgggtttggattcttctgcctggagtcactcgtgagcatctgggttattcagcaagtgtacatgtacttcagggggagcggtaaagcagcagagatgaagcaggaggcaacaagacgagcaatgatggcagctctctgaccacacacctttgagtcttaaccctgaagataacatacaaacagatcctttcctttttcaatcttttttttaactttctttaactaagcggggtttccccgcttttgtattttaatggatttgaaaatccgaactaaaaatgtaaccaaaactttcgatttctttt

SEQ ID NO: 103 - protein, 276 aa, Brassica napus
MSRYESPSFDDGEVNPFANPSTVPAATSQYDRGGATTDIPLDSAGKDLKAKEKELQAKESELKRREQELKRKEDAIAQAGIVIEDKNWPPFFPLIHHDISNEIPIHLQRIQYVAFTSLLGLVVCLLWNIVAVTTAWIKGEGPTIWFLAIIYFISGVPGAYVMWYRPLYRAMRTDSALKFGWFFFTYLFHIGFCVFAAEAPPIIFKGKSLTGILPAIDVLSGNILVGIFYFIGFGFFCLESLVSIWVIQQVYMYFRGSGKAAEMKQEATRRAMMAAL

SEQ ID NO: 104 - DNA, 1341 bp, Brassica napus
  misc_feature (1195)..(1195): n is a, c, g, or t
  misc_feature (1263)..(1270): n is a, c, g, or t
  misc_feature (1281)..(1287): n is a, c, g, or t
  misc_feature (1290)..(1292): n is a, c, g, or t
  misc_feature (1317)..(1318): n is a, c, g, or t
cggacgttcacaggaacatactgatcggaataatacatgataagagccttctgcgttctataattgatatagactatgactgagtcatccgaaactccgtggagtttgtttgcttcattcacacactttcttctgctgcagcggatctgaagtgaacaatgaatcgccaccacgatcccaatcccttcgacgaagaagaagacgagatcgtcaatcccttctcgaaaggagctggcggcgctggaaggcctgtggcatctaggccattcaacgttgatgctacggtcgatattcctttggatacggtgaatgactcttcaaagaaacagagagagctctctgattgggaatcagagcttaagaagagagaaacggatattaaacgaagagaagatgctgttgccaagtctggcgtgaagacaagcgataaaaactggccaccctttttccctatcatacaccacgacattgctaacgagataccagttcatgcacagaaactgcagtatctggcatttgctagttggttgggtatagttttgtgtctcgtgttcaacgtcattgctgtgatagtctgctggattaaaggcggaggtgtcaaaatcttttttcttgccacgatctatgcgctgcttggatgtccaatttcatatctgttatggtacaggcctctctaccgagcaatgaggactgacagcgctctgaagttcggttggtttttcttcttctacctgattcacattgggttctgcatatttgccgccattgctcctccgatcattttccgtggacaatcatttacgggtgtgctggcagcaattgatgtaatcagagacagtttactagccgggatcttctactttgtcggctgtggtctgttctgcttggagtcgcttctcagtctctgggttctccagaaaatatacatctacttcaggggaaacaagtaaacaatgcatatactagagcaaatacctactcctacaataccgccctcttagatggtttgattatagtactatactatcttgcaactactgtaattaccatttgtgcacttgtctgcaatattactctgttgtgtttttttgtactatgtggtgctgtgttctttggttagtagtggcagtggcataagacatactctctgttatgttattacgttgagtattgaaattttttgggtttgcaaaanaaaaaaaaaaaaaaaaaaaaaaaaaaaaaaaaaaaaaaaaaaaaaaaaaaaaaaaaaaaaaaaaaaannnnnnnnaaaaaaaaaannnnnnnccnnntaaaaaaaaaaaaaaattaaaaccnntttttgagaaaaatttttttttt

SEQ ID NO: 105 - protein, 263 aa, Brassica napus
MNRHHDPNPFDEEEDEIVNPFSKGAGGAGRPVASRPFNVDATVDIPLDTVNDSSKKQRELSDWESELKKRETDIKRREDAVAKSGVKTSDKNWPPFFPIIHHDIANEIPVHAQKLQYLAFASWLGIVLCLVFNVIAVIVCWIKGGGVKIFFLATIYALLGCPISYLLWYRPLYRAMRTDSALKFGWFFFFYLIHIGFCIFAAIAPPIIFRGQSFTGVLAAIDVIRDSLLAGIFYFVGCGLFCLESLLSLWVLQKIYIYFRGNK

SEQ ID NO: 106 - DNA, 1051 bp, Glycine max
agcctggaattttcttccttcttactttaccttccttcctcaccttctaattctgcaacaagttccaaactttcaaatctcaccgccccaaaaattcttttttggttacccatttgactttagcctctgcaacagagtctcagatctctgcattccaattcccatggctggtcgctatgacagtaaccccttcgatgaggaagaagttaaccctttctctaatcctggaagtgttcccgctgccactaattcaaggcttccacctcttaagccagaacctgttgattataattatggctttggtgcgacagttgatatacctcttgattcatcaatggatttgaaaaagaaggagaaggaacttcaagccaaggaaactgaattgagaaaaagggaacaggaagtgagacggaaagaagaagctgcttcacgagctggaattgttcttgaggagaagaattggccgccttttttcccaataatccatcatgacattgctaatgaaattccaattcatcttcaaaaattgcaatatgttgcatttactacattgttaggattagtgttgtgccttttttggaatgttatagctgttactgctgcttggattaagggtgaaggtgtaaaaatatggtttcttgccattatctatttcatagcaggggttcctggagcatatgttctgtggtatcgcccattatatcgtgcttttaggaatgaaagtgctttgaaatttggatggtttttcctgttttatctgcttcacataggattctgcatcttagctgcagttgctcctcctatagttttcaaaggcaaatccctgacgggcattctggctgccatagatgtgctgggcgaccatgctttgatcgggattttctacttcattggatttggattattctgcattgaaacgttgatcagcatatgggtcattcagcaagtatacatgtacttacgttgcagtggtaacgctgctgacatgagacgtgagcctgcatgggagcaatcagggctgcaatatgatgcatcgatcatgtgaagaagg

SEQ ID NO: 107 - protein, 293 aa, Glycine max
MAGRYDSNPFDEEEVNPFSNPGSVPAATNSRLPPLKPEPVDYNYGFGATVDIPLDSSMDLKKKEKELQAKETELRKREQEVRRKEEAASRAGIVLEEKNWPPFFPIIHHDIANEIPIHLQKLQYVAFTTLLGLVLCLFWNVIAVTAAWIKGEGVKIWFLAIIYFIAGVPGAYVLWYRPLYRAFRNESALKFGWFFLFYLLHIGFCILAAVAPPIVFKGKSLTGILAAIDVLGDHALIGIFYFIGFGLFCIETLISIWVIQQVYMYLRCSGNAADMRREPAWEQSGLQYDASIM

SEQ ID NO: 108 - DNA, 879 bp, Hordeum vulgare
  misc_feature (796)..(796): n is a, c, g, or t
taattctgcacgaggcctcgtgccgaattcggcacgaggaggaggcgaagcacgccgcacgcagttggccgccaccacgtcgcctgccgccgccgtcggagaaggaggccggacccatggcgggccgcaacggcttcgaggacgacgacgtcaaccccttcgccggagggagtgttccccctgcctccaattctcgactctcacctctctcccacgagccagcgggtttctataatgtggacattcctatggattcaactaaggatgtgaagaaaaaggaaaaagaactccaggcgatggaagccgagctaaacaaaagagaaaaggaattgaaaaggaaggaagaggctgcgtcgcgagctggcattgtcatagaagacaaaaactggccaccctttttccctctcattcaccacaacatttcaaatgagatacccatccatctacaaaaaatgcagtaccttgcattttcatcatttttgggaattgctctctgcctcttctttaatatcatagcgactacaacagcatggattaaaggagaaggtgtcatggtttggttgcttgccattatctacttcatatctggtgtccctggggcttatgtgttatggtatcgccctctttataacgcgatgagaactgagagtgctttgaagtttgggtggttttttctattttacatgattcacataatcttctgcgtgtggtcagctgtgtctcccccattccctttcaaaggaaattctttgactgggattttgcctgccatttgatgtcataaccaaaggagtcnttattggtgggatattctacttcgttgggatttggattggtctgccttgaatcattgctgagcataggtgtcattcaagcaag

SEQ ID NO: 109 - protein, 219 aa, Hordeum vulgare
MAGRNGFEDDDVNPFAGGSVPPASNSRLSPLSHEPAGFYNVDIPMDSTKDVKKKEKELQAMEAELNKREKELKRKEEAASRAGIVIEDKNWPPFFPLIHHNISNEIPIHLQKMQYLAFSSFLGIALCLFFNIIATTTAWIKGEGVMVWLLAIIYFISGVPGAYVLWYRPLYNAMRTESALKFGWFFLFYMIHIIFCVWSAVSPPFPFKGNSLTGILPAI

SEQ ID NO: 110 - DNA, 1297 bp, Hordeum vulgare
agcgacccgcgtccaccaccgccgctttccccgtctcctcccctcaccctcaccctcaccgcgcggcgaggccgagcgacccacccagcggcgagcccggcatgcatcacgaccccaaccccttcgacgagggcaccgccggcgacgaaaaccccttctccaatggaggaggccggggcgggaagcagcagtacggcttcaggcccaccgagcccgtcggcttcggcggcggcggcggcggcggcagcaggggcgacgccaccgtcgatgtgcccctcgacaacatgggcgactcgaatggcaacgcgagggagctctcgtcgtgggaatcagatctgaggcggcgtgaggcggatatcaaaaggagggaggaatcgctcaagaatgctggagtgcccatggaggagaagaattggccgccatttttcccgattatccaccatgacatcgccaatgagataccggccaacgtgcagaagctacagtatctggcgttcgcaagctggcttggaattgtgctctgcctctcctggaactttattgctgtcatagtctgctggatcaaggagggagattcaaagctgttcttccttgctacaatctatgctttgcttggaattcccctttcttacttgatgtggtatcgacccctctaccgtgcaatgaggactaacagtgcattcagttttgggtggtttttcctgtgttatctgatccacattggtttttgcataattgctgccattgctccgccaattgtattccaagggaaatcattaacgggcatattggctgcgatcgacactttctctgagcatttgataattgggatcttttacttcgtcgggtttgcactattttgcttggagacactgctgagcatcggggttcttcagaaagtatacatgtacttccgagggcataagtgaagccgtcatggatgggaaattttcggaactctacaagcagcggtgattctgtccatgtgtgtcagcacacctagagtctatgttctgttctgccaaaggttatcgaaaaatgcttctgagcctgaatcgagtatggaaggtagccctgctaccacaggatgttctctaagatggggtgttgagattctttatatgctgtgcttggtgcgtttggtagttcgtttgggagtttggcatgtcggtgcacattacagtagtcggtattattatcaaacgaaaatgagcaactgggcagcaatcgtatttgttcatccaagcatcttccggctctaatcgtccggttatagcaatatcatctggtgtcacta

SEQ ID NO: 111 - protein, 275 aa, Hordeum vulgare
MHHDPNPFDEGTAGDENPFSNGGGRGGKQQYGFRPTEPVGFGGGGGGGSRGDATVDVPLDNMGDSNGNARELSSWESDLRRREADIKRREESLKNAGVPMEEKNWPPFFPIIHHDIANEIPANVQKLQYLAFASWLGIVLCLSWNFIAVIVCWIKEGDSKLFFLATIYALLGIPLSYLMWYRPLYRAMRTNSAFSFGWFFLCYLIHIGFCIIAAIAPPIVFQGKSLTGILAAIDTFSEHLIIGIFYFVGFALFCLETLLSIGVLQKVYMYFRGHK

SEQ ID NO: 112 - DNA, 1287 bp, Hordeum vulgare
agtgcaaccgtgcgtgccctcctgtatctgccaggactcatcgtctccccctttctcaatcgccattgtcggtggtgcaagcaagcgcgccggggcgtgagggagggacatggcgggccgctacgatggcggcaaccctttcgaggaggaggaggacgtgaaccctttctcggaacaagcgcgaggcaaagctggcgggcagtccaactatggcggcggcggcgcgttctacatgccgaatcccagaaacgttgctccctcttcgaattcccggctttcgccccttcccccggaacctgcagatttcagtgccacagtggatatccctcttgagtcttcaaaggacctgaagaaaagagaaaaggagctgcaagcgagggaagcagagttgaacaagagggagaaggaattgaaaagaagagaggaagcggcagcacgagctggtattgtcatcgaggagaaaaactggcctccttttatgccactcatccaccacgacattgccaatgagataccgactcatcttcaaagaatgcaatacttcgcatttgcgtcatttcttggtttggtttgctgtctcttctggaatgtcgtagcagttactacagcctggatcaagggggaaggtgtgaaaatctggttgctagcaataatctacttcatctctggggttcctggtgcatatgtgttatggtatcgccctctttataatgctatgaggactgacagtgcgttgaagtttggattgtttttcttgctctacttgtttcacatcgtttttgtcgtatttgctgctgtggctcctccagctgtctttgagggcaagtctttggcaggaattttgccggcgattgatcttatcagcatgaatgctctagtggggatcttctacttcattggatttggattatttgccctggagtcattgttgagcatctgggttatccagcaagtgtatatgtacttccgagggagtggaaaggctgcagagatgaagcgcgatgcaaccaggggcgctatgagagcagcattttgattgccacatatctcagatgatgataggactcgagattaattccatggattagatggccccataaacaaaagtatatttttgccttggctcttgactatataatcttaagctggcataggatactgtgatgaggttgacattgtatgacttgtccacttttcttaccgatatagagaatgtgcagttcttacagattatggcccgtcctgaatataaacgctgtgtcctgagagagcagctattaacagtgc

SEQ ID NO: 113 - protein, 308 aa, Hordeum vulgare
MAGRYDGGNPFEEEEDVNPFSEQARGKAGGQSNYGGGGAFYMPNPRNVAPSSNSRLSPLPPEPADFSATVDIPLESSKDLKKREKELQAREAELNKREKELKRREEAAARAGIVIEEKNWPPFMPLIHHDIANEIPTHLQRMQYFAFASFLGLVCCLFWNVVAVTTAWIKGEGVKIWLLAIIYFISGVPGAYVLWYRPLYNAMRTDSALKFGLFFLLYLFHIVFVVFAAVAPPAVFEGKSLAGILPAIDLISMNALVGIFYFIGFGLFALESLLSIWVIQQVYMYFRGSGKAAEMKRDATRGAMRAAF

SEQ ID NO: 114 - DNA, 1030 bp, Hordeum vulgare
aacaggggaaggccagcaggagataggagaagcgcgcgaggggtgatccatgacggcgaggacgaagtacgacaaccctttcgaggagaccggcggcggcgacgaggtcaaccctttcgcggacaaggctactagagaagcaccggctactcaatctggttattctggcggttcattctatgcaacgcaaccacggcctagtccttctaacatcacccgcctttcgcctcttcctccagagccagctgacttctacaatgactttgcctccccacacacaaacaaggacatgaaaacaatggagaaggagcttctggccaaggaggctgagttaagcaggcgagagaaggaaattagaagaagggaagaagctgcggcacgagctggcgttgtcatagaagagaaaaactggcctccgtttttccccatcattcatcatgatatcaacaatgagatacccgtgcatcttcaaagaacacaatatgtcgcctttgcgtcacttttgggattggtcgtgtgcctttttttggaacatcgtctgtgttactgccgcttggattaaaggggaaggtcccaagatctggtttcttgcggtcatctactttattcttggttgcccaggtgcctactatctgtggtaccaaccactttaccgcgccatgagctatttctccttcaattctgtttgtgggaaaatcactgacagggattttcccatcgatcagcttgatagggaagagcgtcatagtaggggtgttctactttcttggctttgcaatgttctgcctcgagtcgtcactaagcatgtgggtcattcagcgcgtgtatcactattttcgaggaagtgggaaagaagcacagatgaagcgtgaggtagcacgcgccacagctagggcagcattttgatactgaaaaatgatgcacacattgtatatggtttttgctctcgcaacttttaaattgcagaggctttgtaagttaactggcatgtaggaacttgtttgtcctatgcaaaagtttttaccctttt

SEQ ID NO: 115 - protein, 170 aa, Hordeum vulgare
MTARTKYDNPFEETGGGDEVNPFADKATREAPATQSGYSGGSFYATQPRPSPSNITRLSPLPPEPADFYNDFASPHTNKDMKTMEKELLAKEAELSRREKEIRRREEAAARAGVVIEEKNWPPFFPIIHHDINNEIPVHLQRTQYVAFASLLGLVVCLFLEHRLCYCRLD

SEQ ID NO: 116 - DNA, 1050 bp, Medicago truncatula
gatttgtttgcatccattttgttgttgtcttacataagaagattcaaaatttgtaacttcttcattctttgatcccaacttccaaatctcctttcttcccttaacaacacaacagttgctactttcttgtattctcctctgcttgcttgtttttatcttatcatggccggtcgttacgacagtaaccccttcgacgaagaacaagtcaaccccttttctaattctggaggtgttgcccctgccacaaattcaagacctgcacctcttaatcccgaacgtgctggttacaattatggttttgggcagacagttgatatacctcttgatgcatcaacggatgtcaaaaagaaggaaagagaactccaagctaaggaggctgaattaagaaaacgagagcaggaagtaagacggaaagaagaagccatttcaagagctggaattgttattgaagagaagaattggccaccatttttcccaattatccatcatgatatcgcgaatgaaattccagttcaccttcaaagacttcaatatgttgcgtttttttcgttgttagggttagtgttgtgccttacatggaatgttgtagctgtcaccgcagcttggattaagggagaaggtgtaaaaatatggtttcttgccattatctacttcatagcaggggttcctggagcatatgtcctgtggtataaaccattatatcgtgcatttaggactgacagtgctattaaatttggatggttttttctgttttacctgcttcaccttgggttctgtatcttagctgctgttgcccctcctatagttttcaaaggaaaatccctgacgggaattctgtcagccatagatgtgattggtgactatactattattgggattttctacttcattggatttggattgttctgtctttgaaacattgatcaatgtctgggttatccagcaagtatatatgtacttccgtggcggtggtaagactgctgagatgaagagggaagctgcactgggagcaatgggggctgctctacgatgaagcaccttctgaaggca

SEQ ID NO: 117 - protein, 250 aa, Medicago truncatula
MAGRYDSNPFDEEQVNPFSNSGGVAPATNSRPAPLNPERAGYNYGFGQTVDIPLDASTDVKKKERELQAKEAELRKREQEVRRKEEAISRAGIVIEEKNWPPFFPIIHHDIANEIPVHLQRLQYVAFFSLLGLVLCLTWNVVAVTAAWIKGEGVKIWFLAIIYFIAGVPGAYVLWYKPLYRAFRTDSAIKFGWFFLFYLLHLGFCILAAVAPPIVFKGKSLTGILSAIDVIGDYTIIGIFYFIGFGLFCL

SEQ ID NO: 118 - DNA, 1447 bp, Medicago truncatula
ttctctctgtttatgtctttgttgaattgctgaccaaagacaattcttttgtatttgtacctgtaattacctcaccaccttcttttccttcttttacaactttcaaacttctttcaaatctcaactctccaacataattctttattttttttgctatccatttcatttgactttattcatctctgcaccaccgccacagatctcatggctggtcgctatgaaagcaacccttttgatgaagaagaagttaatcccttttctgaaccagctgcaaagggaaaaacatcaagccaatcaaactacagtggtggtgcattttacacaacaaatcctggaagtgttccacctgccaagaattcaaggctttcacctcttgagccagagcctgctgattataataattatggctttggcgcaacagttgatatacctcttgatacatcaacggatttgaaaaagagggagaaggaactccaatccaaggaggctgatttgagaagaagggaacaggaagtgagacgaaaagaagaagctgctgcacgagctggaattgttcttgaggaaaagaattggccaccatttttcccaattatccatcacgacattgctaatgaaattccggttcatcttcaaaaattgcaatatgttgcatttactacatatttgggactagtggcatgcctattgtggaatgttatagctgttactgctgcttggattaagggtgaaggtgtaaaaatttggtttctggccattatctacttcatatcaggggtacctggagcatatgttctgtggtatcgtccattatatcgtgtttttaggacggaaagtgctttgaaatttggatggtttttcatgctttatctggttcacataggattctgcatcttagctgctgttgctcctcctatagttttcaaaggaaaatccctgacgggtattctatctgccatagatgtgatagacaactctactttgatcgggattttctactttattggatttggatttttctgtctggaaacgttgataagcatttgggttattcagcaagtatacatgtacttccgcggaagtggtaaggctgctgagatgaaacgggacgttgcaaggggagcagtgagagctgcattctgatgagaaggcagtatggattaccttttcatggatcaatatatgtatattactagccacaaataatgtgaagaaaaatattattctgatggtgattttcgtgtacaagttttatttatttgttcttctcttgtttaacatgttagctattcatgtggtttgttagtgtacattataagcagagatttgacttagcagtggctggtagaaaagtgcaatagtgaaactcatgtaattcatagatattgtgccagtggtgatgctttttctcaagtttctttaacaggtgtgatcctagtcttgttaggca

SEQ ID NO: 119 - protein, 311 aa, Medicago truncatula
MAGRYESNPFDEEEVNPFSEPAAKGKTSSQSNYSGGAFYTTNPGSVPPAKNSRLSPLEPEPADYNNYGFGATVDIPLDTSTDLKKREKELQSKEADLRRREQEVRRKEEAAARAGIVLEEKNWPPFFPIIHHDIANEIPVHLQKLQYVAFTTYLGLVACLLWNVIAVTAAWIKGEGVKIWFLAIIYFISGVPGAYVLWYRPLYRVFRTESALKFGWFFMLYLVHIGFCILAAVAPPIVFKGKSLTGILSAIDVIDNSTLIGIFYFIGFGFFCLETLISIWVIQQVYMYFRGSGKAAEMKRDVARGAVRAAF

SEQ ID NO: 120 - DNA, 598 bp, Medicago truncatula
tcactatcacactctgaagtgattctctcaacagattcggtgttttcgcacattttcttcggatcttaattctcaccatgaatcgcaaccacgatcccaatcctttcgaagaagaagaagtcaatccattttcgaatggtactggatcaaaatcacgtgttccctcagtggcttctgaaccactaggctttggtcaaagacatgatgctactgttgatattcctttggagacttcaaatggggactccaagaaaaaaagtcaagagctagcagtgtgggaagctgatttgaaaaggagagagaaggatataaaaagaagggaagattctgttgctaaagctggtgtgcctgttgatgataagaattggcctccatttttcccaatcattcaccatgatattgccaatgagattccagttcatgctcagagattgcaatattcagcctttgctagttggttgggaatcgttctctgcttagtttttaatgtagttgcagtgattgtctgtttggatcagaggcgggggtgttaaaatatttttccttgcaatgatttatgcgctgcttgggattcccctttcatatgtgctttggtaca

SEQ ID NO: 121 - protein, 151 aa, Medicago truncatula
MNRNHDPNPFEEEEVNPFSNGTGSKSRVPSVASEPLGFGQRHDATVDIPLETSNGDSKKKSQELAVWEADLKRREKDIKRREDSVAKAGVPVDDKNWPPFFPIIHHDIANEIPVHAQRLQYSAFASWLGIVLCLVFNVVAVIVCLDQRRGC

SEQ ID NO: 122 - DNA, 1353 bp, Oryza sativa
aattccaaacccactaggttacgtaaaagcggaagcccggaggccggagcagttggtcgccaccgtcacgcgcgttccccttccctcgccggagagagaaaccaccgacgcggccgcttccggaggaggaggaggagttggggtggaggggagctatggcggggaggtacgaccggaaccccttcgacgaggacgacgtcaaccccttcgcgggtggaagtgtacctccagcttccaactctcggatgccacctcttcctcacgaacctgggttctataatgatcgtggtgccacagtggacatacctcttgattcaaccaaggacatgaagaaaaaggagaaagaactgcaggcaaaggaggctgagctaaacaaacgggaaagcgaattgagaagaagagaagaagctgcatccagagctgggattgtcattgaagagaaaaactggccacccttcttccctattattcatcatgacatttcaaatgagataccaatccacctacaaaggatgcaataccttgcattttcttcattgttgggattggcggcatgtcttttctggaacataattgcaactacagcagcatggattaaaggggcaggtgttatgatctggttgctagccattatctactttatatctggtgtacctggagcctatgtgttatggtatcgccccctttacaatgcgatgaggactgagagtgctttgaagtttggatggtttttcctgttttacttgatccatatactgttctgcatctggtctgctgtggctcccccatttcctttcaaaggaaagtctctggctgggattttgccggctattgatgtcataggaaacaatgctattgtggggatattttacttcattggatttggactgttctgccttgaatcactactcagcgttgttgtcatccagcaagtatacatgtatttccgtggaagtgggaaggctgctgagatgaaacgtgaggcagctcgtggtgctatgagatcggccttttgatagagctgcttcgatggacgggagagaataggatgtgtcgttctgtggtggcgccttgtacatccctacacctatgttgttcgtatctaagttattccattttacagcagcatatagctaaaggattttcctgccttaatgtaatatatgttcactggggccttttatggatacctcaagagctttttacctaggttcagatgtgcctatagttaatgttttccttttgaaatcctgcatgatcacaatggttcctagggccgtattgattctttgtggcaggaaacagtttggtttactaactatttttcttctttgttaatatataaatattaag

SEQ ID NO: 123 - protein, 286 aa, Oryza sativa
MAGRYDRNPFDEDDVNPFAGGSVPPASNSRMPPLPHEPGFYNDRGATVDIPLDSTKDMKKKEKELQAKEAELNKRESELRRREEAASRAGIVIEEKNWPPFFPIIHHDISNEIPIHLQRMQYLAFSSLLGLAACLFWNIIATTAAWIKGAGVMIWLLAIIYFISGVPGAYVLWYRPLYNAMRTESALKFGWFFLFYLIHILFCIWSAVAPPFPFKGKSLAGILPAIDVIGNNAIVGIFYFIGFGLFCLESLLSVVVIQQVYMYFRGSGKAAEMKREAARGAMRSAF

SEQ ID NO: 124 - DNA, 1739 bp, Oryza sativa
ccccgcgacaccaaccgatttcgcagcgccagcccactgattcctcaccgaattttttcattttttttctctctttccattctccccggcgatcgagtagccggcttctgctcgccgcccgcgcgccggagggaggcgaggtccaaagccggcgaggcgccatgcaccacgaccccaaccccttcgacgagggcgccgacgataaccccttctccaatggaggaggtggtggagcacgtcgtggtggtggtggcggcggtggtggtggcggtggcggaggcaagtctcagttctcgttcgggttcggcggcctcggcggcggcagcaagggcggtgccactgtcgacatccccctcgacaacatgagcgattcgaagggcaaggggaaggagctgttgcaatgggaggcagatctcaagagacgagaggcggatatcaggagaagggaggaagctctcaagagtgccggggtgcccatggaggagaagaactggccaccattcttcccaattatccaccacgacattgccaacgagatacctgccaatgcacagaagttgcagtaccttgcatttgcaagctggcttgggattgtactttgtctcttctggaattttattgctgtcattgtctgttggatcagaggaggagattccaagctctttttcctggctactatctacggtatgcttggaatgcctctgtcatacttgatgtggtataggcctctgtaccgcgcaatgagaactgatagcgcattcagctttggatggtttttcctttgctacatgcttcacattgccttctgtgtatttgctgccatcgctccaccagttatatttcgtggaaaatcattaactggtatattggctgcaattgacaccttctctgatcatgcaatagtcgggatcttttactttgtcggatttgccttgttttgcttggagacacttgtgagcatttgggttcttcagaaagtatacatgtatttcagagggcacaagtgaagtgggccgtggaagaaatattacaaaagcccaccaaatactatctgattgagctgcagttctgtgcatacatatatgtacatgtcgatcttgtatgttatgtagtgatggagatgttctaagtacatgtcaatctatagtgttattttttttaacaggaatactattttatagtgttgttttctgggctgatcggtctgttgtgttgaacctcaattctttacctatacaaattgcactttgttcactcttttgtttgatagttcaattttacggttgattggtctgttggcctacgacaagagccatgctcgttggaaccagaagacagcaacccatctgtctggggatctcatttgtgctttgagacttggaaggaatcttgcactccttggagattcagcttccgccgaacttgggatcaggtgcagtcccaactacaactgctgaacttgggatcaggtgcagtcccaactacaactgcacgttagggactgcacaagatcttgtccattcaatttttcagtggaagatctagattaaatgctacaataaccttgttataataattttgtgctagattgtttgaatgaacagtgtccattaaatttgggctttggatttgcatcccacagccgtagcatgactgtctaagttgcagtcatactggactgcacaggaaccaaattcgtactcttgtgctcaccaatgtttatgtatttttttaacagc

SEQ ID NO: 125 - protein, 281 aa, Oryza sativa
MHHDPNPFDEGADDNPFSNGGGGGARRGGGGGGGGGGGGGKSQFSFGFGGLGGGSKGGATVDIPLDNMSDSKGKGKELLQWEADLKRREADIRRREEALKSAGVPMEEKNWPPFFPIIHHDIANEIPANAQKLQYLAFASWLGIVLCLFWNFIAVIVCWIRGGDSKLFFLATIYGMLGMPLSYLMWYRPLYRAMRTDSAFSFGWFFLCYMLHIAFCVFAAIAPPVIFRGKSLTGILAAIDTFSDHAIVGIFYFVGFALFCLETLVSIWVLQKVYMYFRGHK

SEQ ID NO: 126 - DNA, 1831 bp, Oryza sativa
ggggtatgttgttgcatcacgcatatatatactttctgtctttcttgacatcatgtcgcaatccaatggaaagaacagatacggggaaggccgttctcgcaaaatttcagctatgaactcgcgaaatcttgcaacatggatgaaattttgcgaatatctagtaaagtgtgtaatgtagaaacgtacgcggtcgctgtcagggtggcgtagagggggcggcaaagtgagagaaaaacattaggccgagtctgagtcgttgcaaggctgaggtgtttgacggcaacaaaaaaagtaaacacgacgggctgagcctgagcctgccaaatccacgcggagtccgctaaaatttttccactggttctagatgatcgccatcgatgatgcaacgaccaactgcttcctctgcggaatagctgaataaattcagagttcaggtccatctaggctgctgctgctgctcttcgtctttgctgacctcggcacaggcagagagagaagccaagaaaagggaaaagagaggaagaagagagggaagaggagaagggagacgcgcggtgatcggaggttgatccatggctggcaggtcgagatacgacaaccccttcgaggagggcggcggcgacgaggtcaaccctttcgcggataaagcttctaaaggaggatcagcaggtcaatccagctattccggaggcgcattctatacaacacaatcacgccctagtgctccaccggccacccacctttcgcctcttcctcctgagccagctgacttctacaatgacttctcgaccccggtggatattccaatggacactagcaaggatatgaaaacaagggagaaggaacttcttgcaaaggaagccgagctaaacaggcgagagaaggaaatcaaaaggagagaggaggctgcagcacgagctggtattgtgttggaagacaaaaactggcctccatttttccccatcatccataatgatattggcaatgagatacctgtccacctgcaaagaacacagtatgtcgcatttgcgtcactcttaggattggtcctgtgcttgttttggaacatcatctgtgttacggctgcttggattaaaggggaaggtcccaagatctggtttcttgctgtcatctatttcattcttggatgcccaggtgcctactatctgtggtaccgaccactttaccgtgccatgaggaatgagagtgctctgaaatttggatggtttttcctgttctacttggtccacatcgctttctgtgtgtatgcggctgtttctccatcaattctatttgtagggaaatcattgacaggaatttttccagcaatcagcttaataggcaatactgttatcgttggggtgttttattttcttggattcgcaatgttttgcctggagtcgctgctcagcatgtgggttattcagcgtgtgtatctttacttccggggcagcgggaaagaggccgagatgaagcgcgaggctgcacgcagcgcagcgagggcggcgttttgatgatgatgtacgtatgcgtgaaatgcataggagtgtccattgtttgaaaaattactgtgcgctgtaaatttggagagtggtagtagagttgttctgcttatgatatgtaggattttgtgacttgatttgagatttcttccgctgtccatgtccatttcttctgatctgttctaacttcatgctttgcactttagggatactagtatatatttgagagagaaaaattgtggcattaggacttgccagatctatgtatgtaacaaaaagcatacctttctgcatgccgtttctaaacatggagtttgattttcattgcc

SEQ ID NO: 127 - protein, 313 aa, Oryza sativa
MAGRSRYDNPFEEGGGDEVNPFADKASKGGSAGQSSYSGGAFYTTQSRPSAPPATHLSPLPPEPADFYNDFSTPVDIPMDTSKDMKTREKELLAKEAELNRREKEIKRREEAAARAGIVLEDKNWPPFFPIIHNDIGNEIPVHLQRTQYVAFASLLGLVLCLFWNIICVTAAWIKGEGPKIWFLAVIYFILGCPGAYYLWYRPLYRAMRNESALKFGWFFLFYLVHIAFCVYAAVSPSILFVGKSLTGIFPAISLIGNTVIVGVFYFLGFAMFCLESLLSMWVIQRVYLYFRGSGKEAEMKREAARSAARAAF

SEQ ID NO: 128 - DNA, 1818 bp, Oryza sativa
ggggtatgttgttgcatcacgcatatatatactttctgtctttcttgacatcatgtcgcaatccaatggaaagaacagatacggggaaggccgttctcgcaaaatttcagctatgaactcgcgaaatcttgcaacatggatgaaattttgcgaatatctagtaaagtgtgtaatgtagaaacgtacgcggtcgctgtcagggtggcgtagagggggcggcaaagtgagagaaaaacattaggccgagtctgagtcgttgcaaggctgaggtgtttgacggcaacaaaaaaagtaaacacgacgggctgagcctgagcctgccaaatccacgcggagtccgctaaaatttttccactggttctagatgatcgccatcgatgatgcaacgaccaactgcttcctctgcggaatagctgaataaattcagagttcaggtccatctaggctgctgctgctgctcttcgtctttgctgacctcggcacaggcagagagagaagccaagaaaagggaaaagagaggaagaagagagggaagaggagaagggagacgcgcggtgatcggaggttgatccatggctggcaggtcgagatacgacaaccccttcgaggagggcggcggcgacgaggtcaaccctttcgcggataaagcttctaaaggaggatcagcaggtcaatccagctattccggaggcgcattctatacaacacaatcacgccctagtgctccaccggccacccacctttcgcctcttcctcctgagccagctgacttctacaatgacttctcgaccccggtggatattccaatggacactagcaaggatatgaaaacaagggagaaggaacttcttgcaaaggaagccgagctaaacaggcgagagaaggaaatcaaaaggagagaggaggctgcagcacgagctggtattgtgttggaagacaaaaactggcctccatttttccccatcatccataatgatattggcaatgagatacctgtccacctgcaaagaacacagtatgtcgcatttgcgtcactcttaggattggtcctgtgcttgttttggaacatcatctgtgttacggctgcttggattaaaggggaaggtcccaagatctggtttcttgctgtcatctatttcattcttggatgcccaggtgcctactatctgtggtaccgaccactttaccgtgccatgaggaatgagagtgctctgaaatttggatggtttttcctgttctacttggtccacatcgctttctgtgtgtatgcggctgtttctccatcaattctatttgtagggaaatcattgacaggaatttttccagcaatcagcttaataggcaatactgttatcgttggggtgttttattttcttggattcgcaatgttttgcctggagtcgctgctcagcatcgtgtgtatctttacttccggggcagcgggaaagaggccgagatgaagcgcgaggctgcacgcagcgcagcgagggcggcgttttgatgatgatgtacgtatgcgtgaaatgcataggagtgtccattgtttgaaaaattactgtgcgctgtaaatttggagagtggtagtagagttgttctgcttatgatatgtaggattttgtgacttgatttgagatttcttccgctgtccatgtccatttcttctgatctgttctaacttcatgctttgcactttagggatactagtatatatttgagagagaaaaattgtggcattaggacttgccagatctatgtatgtaacaaaaagcatacctttctgcatgccgtttctaaacatggagtttgattttcattgcc

SEQ ID NO: 129 - protein, 295 aa, Oryza sativa
MAGRSRYDNPFEEGGGDEVNPFADKASKGGSAGQSSYSGGAFYTTQSRPSAPPATHLSPLPPEPADFYNDFSTPVDIPMDTSKDMKTREKELLAKEAELNRREKEIKRREEAAARAGIVLEDKNWPPFFPIIHNDIGNEIPVHLQRTQYVAFASLLGLVLCLFWNIICVTAAWIKGEGPKIWFLAVIYFILGCPGAYYLWYRPLYRAMRNESALKFGWFFLFYLVHIAFCVYAAVSPSILFVGKSLTGIFPAISLIGNTVIVGVFYFLGFAMFCLESLLSIVCIFTSGAAGKRPR

SEQ ID NO: 130 - DNA, 852 bp, Oryza sativa
atggcggccggagggaggtgggggcacagcgacaacccgttcgaggaggtcgagatagatcaggtcaaccccttctcgcacccacgtccaactccactccctcatgaacctgttgccttctacaatgaccctggtgcatccgtggatcctcttgatagtaaaaagggcctgaagaaaaaggagagagaactattggctaaagaggctgagctaaacaagagagaacaggaactaaaaagaagggaagaagcacttgcaagagctggagtttttatagagccaaaaaactggcctccattcttccccgtcattcatgttgatatctcaaatgacatacccgtgcacttgcagcgagtgcagtatgtcgcttttgcatcactcctagggttggtgatatgcctcttctggaacataatatgtgtcagtgctattgcgattatgtggggcgaccctagggcctggtttctggctgccatatacttcattacaggatgcccaggtgcctatttttcatggtaccggcctctttatcgtgccatgaggaaagaaagtgctttcagatatgggtggttcttcctgttctactttttccatatatctttctgcatctatgcagccatttctccatcaatttttttcgttggaagatcattgacgggaatttttcaagcgatcaacgtgataggctacaatggtgcagtcgggatattattcttcctgggtttcgcgatgttcgtccttgagacgttgctgagcatatgggtcatgcagaaagtatattggtatttccgcgggaaagggaaggaggccgagatgaggcctgatgctgcagcaggcggctcacggttctga

SEQ ID NO: 131 - protein, 283 aa, Oryza sativa
MAAGGRWGHSDNPFEEVEIDQVNPFSHPRPTPLPHEPVAFYNDPGASVDPLDSKKGLKKKERELLAKEAELNKREQELKRREEALARAGVFIEPKNWPPFFPVIHVDISNDIPVHLQRVQYVAFASLLGLVICLFWNIICVSAIAIMWGDPRAWFLAAIYFITGCPGAYFSWYRPLYRAMRKESAFRYGWFFLFYFFHISFCIYAAISPSIFFVGRSLTGIFQAINVIGYNGAVGILFFLGFAMFVLETLLSIWVMQKVYWYFRGKGKEAEMRPDAAAGGSRF

SEQ ID NO: 132 - DNA, 1436 bp, Oryza sativa
gagaaaaagcggcgcaaaagcgagtgaaccgcttgaaccggaagcgactcgagtccaagccaagccacgcgctgcaccactcgccgctttacccgccgttctcctcctcctcctcctccacgcgcggcggcgaggcggagccaagccctaggaaggagcggcgcgtcaccggcggcggcggcggcatgcatcacgaccccaacccgttcgacgagggcaacgccgacgacaaccccttctccaatgggggaggtggtggtggcggcggcggcagcaggcagcagtacgggttccgccccacggagcccgccggcttcggcgccggcaggggggacgccaccgtcgatgtcccgctcgacaccatgggcgactccaagagcaaggcaagggagctctcatcgtgggaaacagatctgaagcggcgggaggcggatatcaaaaggagggaggaagcgctgaggaatgctggagtgccaatggaggataagaactggccaccattcttcccgatcattcaccatgacattgccaatgagataccggctaatttgcagaaattgcagtatctcgcgttcgcaagctggcttggtatcgtgctttgcctctcatggaacttcatcgctgtcatagtctgttggatcaaggagggagattcgaagctgtttttccttgccactatctatgccttgcttggaattcccctctcgtacttgatatggtataggcctctctaccgtgctatgaggactaacagtgcgttcagttttggatggttctttctctgttacttgatccacattggcttttgcattattgctgccattgccccgccaattgtgtttcatggaaaatcattaacgggcatactggctgccatagacaccttttctgagcatgtgataattgggatcttttactttgtggggttcgcgctgttttgcttggagacactgctgagcattggagttcttcagagagtgtacatgtacttcagagggaacaagtgaagctattcatcatgatggaaagtttccggtgatcaccagtagcacacctcttcatgcatcgcttctgtgcatacaaatcagtacaccctgagaatgtctcttcatgtcagtttattgtgaaaccttttcaagcttgttatggggtaggttgttagcatcgttatcatagctttgtgtctggaacgaggtgttttgattcttggcaaactgtagtccgtatgtgattgggtagatcgccggtttgcctgttggttaccgttaaatgagctaaggctattctcgctcgggaaaatagacacaaaattgcattcagacctggatcatatatatgcacccttgcggattgttggcttgatgctgtgcttcccgatttttactatccatctaactcaaagcagattcatctggcacaattcgttgcaagtttcc

SEQ ID NO: 133 - protein, 273 aa, Oryza sativa
MHHDPNPFDEGNADDNPFSNGGGGGGGGGSRQQYGFRPTEPAGFGAGRGDATVDVPLDTMGDSKSKARELSSWETDLKRREADIKRREEALRNAGVPMEDKNWPPFFPIIHHDIANEIPANLQKLQYLAFASWLGIVLCLSWNFIAVIVCWIKEGDSKLFFLATIYALLGIPLSYLIWYRPLYRAMRTNSAFSFGWFFLCYLIHIGFCIIAAIAPPIVFHGKSLTGILAAIDTFSEHVIIGIFYFVGFALFCLETLLSIGVLQRVYMYFRGNK

SEQ ID NO: 134 - DNA, 1392 bp, Oryza sativa
ggagagagagacagcgcacgctagtggagcagctgctgcagcggttggccaccgcctccatcgccgtcgccgactcgccgccatcgtcgttgccgtcgtcgccgtcggcggagtaggcaggcggccatggcggggaagcacggccgcaacggcttcgaggacgacgacgtcaatcccttcgcgggaggaagtgttcctcctgccaacaattctcgactcccacctctctcccatgagccagctgatttttacaatgtggacattcctcttgactcgtctaaggatttgaagaaaaaggagaaagaactccaggcaatggaagctgaactaaacaaaagagaaagggaactgaaaaggaaggaagaggctgcagcccaagctggcattgtcattgaagataaaaattggccaccctttttccctctcattcaccataatatttcaaatgagatacctattcatctacaaagaatgcagtaccttgcattttcatcgtttttgggattggcagcctgcctattttggaatatcatagcaaccacaaccgcatgggtaaaaggggaaggtgttattatctggttgcttgctattatctacttcatatctggtgtacctggtgcttatgtgttatggtaccgccctctttataatgcaatgagaactgagagtgctttgaagtttgggtggttttttctgttttacctgattcatataatcttctgtgtgtgggcagctgtggctcctccttttcctttcaaaggaaaatctttggctgggattttgcctgccattgatgtcataggcaggagtgctatagtggggatattttactttgtcgggtttggattattctgccttgagtcactgctgagcattggtgtcattcagcaagtatacatgtacttccgtggaagtggaaaagccgcagagatgaaacgtgaggcggcacgtggtgctctgagctccgcattctgatgaaacatgccttgagcaaaactgtagccagatgatatgagtgggaggaaacacgaaacatgagttgccaatctagcattcgcatagtgtacatccctgacggctgaacagcgtgcggatttggaatcaccgaaagcacccagccattattatcttttttgctcttctgtaatatataagcagcgttcttgtatggacgcgttcaggtgtttgtttccatttgttgacaaagattttagatgtggacgtgtgttgatagggaatagacatacatacgcgtgcgcgagtgggatcacctgttttttattacttcctttgcagcatagttgcagcacgttgtgtttatctgttgacacgattttcgtgagttataagatgattgatgtcctctaaaaattctctgttctgctggtcatt

SEQ ID NO: 135 - protein, 282 aa, Oryza sativa
MAGKHGRNGFEDDDVNPFAGGSVPPANNSRLPPLSHEPADFYNVDIPLDSSKDLKKKEKELQAMEAELNKRERELKRKEEAAAQAGIVIEDKNWPPFFPLIHHNISNEIPIHLQRMQYLAFSSFLGLAACLFWNIIATTTAWVKGEGVIIWLLAIIYFISGVPGAYVLWYRPLYNAMRTESALKFGWFFLFYLIHIIFCVWAAVAPPFPFKGKSLAGILPAIDVIGRSAIVGIFYFVGFGLFCLESLLSIGVIQQVYMYFRGSGKAAEMKREAARGALSSAF

SEQ ID NO: 136 - DNA, 1576 bp, Oryza sativa
ggttacaagctgcagaagtgcagaggccattccgttccgcgtgtgtgcgcgtccacccgcctccccctccccttcttcaccgagagtcgtcgcggtcactcgtccgtatctgcctcggtgggggcggcggtgcgtgcgtgcgtgcgcggccgctgtatttggcaggactcctcgtctcgtcgtctccctctcccccgagaaaaccccaccccactactcctctccaccgccatcattgtcggcgcgagcgagagcccaagcccaagccgacccccgagggaaggggaagacggggccgagatggcggggcgctacgacagcaaccccttcgaggaggacgacgtgaaccctttctcggaacaagcgcgtggtaaggctggagggcagcccagctatggcggcggcgcgttctacatgccgaatccacggaatgtgccttctgtgtcgtcgaattcgcggctttcgcctcttccccctgagcccgcagcttttggggctacggtggatatccctcttgactcttccaaggacctgaagaatagggaaaaggagctgcaagctagggaagcggaattgaacaagagggagaaggagctaaaaaggagggaggaggctgcagcgcgagctggtattgtcattgaggagaaaaactggcctccatttctgccactcatccatcatgatatcaccaatgagataccgagtcaccttcaaagaatgcaatatgttgcatttgcatcatttcttggattggcttgctgtctcttctggaacgtcatagcagttacttcagcttgggtcaagggggaaggcgtgaagatatggttgctggcaatcatctacttcatctctggggttcctggtgcatatgttttatggtatcgacctctgtataatgctatgaggactgatagtgccttgaagtttggattgttcttcttggtttacctgttccatattcttttctgtgtattttctgctgtggctcctcctgttgtcttcgaggggaaatcattggcggggattttaccagcaattgatctcatcagcaagaatgctttggtggggatcttctactttgttggatttggattgttctgcgtcgaatcattgctcagcatctgggttatccagcaagtgtacatgtacttccgaggaagtggaaaagctgctgagatgaagcgtgatgcaactaggggtgctatgcgggcagctttttaattatcagaaaagattattggtccgactcatatctctgatggaatggatagattgtggtataaacgaacatatatgttttccctgtttgctgactacaatttcaaattgttagtaggttacagtgacgttgtatgacctgtcctcttgattcatcaatatagagaatgtgcagttgttacttgttacaggctttacagctggtgttactagcgtagaacattttcgttttcgtctgggctaaaaaagtataaatcgacaccaatgaatgattcagcccatgaaagaattctctttgttatatgtacaggaaacaaatcagataggcaatcaaatgctatttgttggtgactcgtcc

SEQ ID NO: 137 - protein, 306 aa, Oryza sativa
MAGRYDSNPFEEDDVNPFSEQARGKAGGQPSYGGGAFYMPNPRNVPSVSSNSRLSPLPPEPAAFGATVDIPLDSSKDLKNREKELQAREAELNKREKELKRREEAAARAGIVIEEKNWPPFLPLIHHDITNEIPSHLQRMQYVAFASFLGLACCLFWNVIAVTSAWVKGEGVKIWLLAIIYFISGVPGAYVLWYRPLYNAMRTDSALKFGLFFLVYLFHILFCVFSAVAPPVVFEGKSLAGILPAIDLISKNALVGIFYFVGFGLFCVESLLSIWVIQQVYMYFRGSGKAAEMKRDATRGAMRAAF

SEQ ID NO: 138 - DNA, 669 bp, Oryza sativa
atggcgccggggccggagaagaagaaatcatggatgccggcgggcttgggaggcagcggcaagcttggcgccaccattgacatccccctagaggatccgaggaagaaggagaaagaactcttggcatgggaggaggatttgaggcgaagggagctggatatcaaacagagggagaatgcaatggacagggctggggtcactgtcgaagtgaaaaattggccgcctttctaccctatcatccatcatgatatagccagtgaaataccaatccatgctcagaagttgcaatacatggcatttggtagttggctagatgttgtgctttttctcttcgcaattatctacgcaatatttggatgtcctctttcatacatactgtggtacaggcctctgtacagcgcaatgagaactgatagcatggttacctttgtccagtttttcgtcttctactcgatacatgtcggattttgtgtcattgctgcagttactcctccaataatatttaagggaaaaactcttacgggaatcctggttgcaatcgaagttttaactggagatatgttcgttggagtgctttatttaattggatttacatttttcaccttggaatctattataagcatctgggtgcttgagagagtctacatgcatttcagagggcacaggtga

SEQ ID NO: 139 - protein, 222 aa, Oryza sativa
MAPGPEKKKSWMPAGLGGSGKLGATIDIPLEDPRKKEKELLAWEEDLRRRELDIKQRENAMDRAGVTVEVKNWPPFYPIIHHDIASEIPIHAQKLQYMAFGSWLDVVLFLFAIIYAIFGCPLSYILWYRPLYSAMRTDSMVTFVQFFVFYSIHVGFCVIAAVTPPIIFKGKTLTGILVAIEVLTGDMFVGVLYLIGFTFFTLESIISIWVLERVYMHFRGHR

SEQ ID NO: 140 - DNA, 930 bp, Physcomitrella patens
atggcggggcggtacgatagaaatcctttcgagccagaggaggaggaagtgaatccattttctgtaatggttcgggcgcaggcaacgaagccgtcctatggcggtggtggcctttttaatgacccggaacctgaaattttgttacaggtgtcgaactctagattatctcctcttccgcatgaaccggcattctcaggagttgatgacgccacggtggatattccactgggtgctggaaaggacttgaagaagaaggaaaaagagcttaaagccagagaggaagaattgagaagaagggagcaagatttgaagcgcagagaggaagctgctgaaagagctggtattaggatagagaagaagaattggccccccttcatcaacattctccatcatgacatcgcgaatgatatcccagcgcattctcgaggattgcagcgctgggcctatgcaagttggttaggaattctactctgtctattttggaacttcatttgcgtgaccgcagcgtggatcgggggtgttggtggtgtgagtatttttcttctcggtattgtttacatgctgtctggctatgttctgtcctactttctgtggtataagcccctctaccgggcaatgaggtctgatagcgttctgaggttcgggtggtttgtgatgttctatctgctccatatcgcattctgtgtgtatgccgctgttgctcctcctttcatcttcaaaggaaagtcgcttgcgggaatcataacagctatcgatattttctcctcgaatataattattggtatcttttacgtggtcggctttgccttattcacacttgagtcgctcctcagcatctgggttctgaagggtgtagttcaatacttcagaggtgaaggagcagcagcagagatgaagcggaacgctgcagcaagcagagtagctatctga

SEQ ID NO: 141 - protein, 309 aa, Physcomitrella patens
MAGRYDRNPFEPEEEEVNPFSVMVRAQATKPSYGGGGLFNDPEPEILLQVSNSRLSPLPHEPAFSGVDDATVDIPLGAGKDLKKKEKELKAREEELRRREQDLKRREEAAERAGIRIEKKNWPPFINILHHDIANDIPAHSRGLQRWAYASWLGILLCLFWNFICVTAAWIGGVGGVSIFLLGIVYMLSGYVLSYFLWYKPLYRAMRSDSVLRFGWFVMFYLLHIAFCVYAAVAPPFIFKGKSLAGIITAIDIFSSNIIIGIFYVVGFALFTLESLLSIWVLKGVVQYFRGEGAAAEMKRNAAASRVAI

SEQ ID NO: 142 - DNA, 990 bp, Physcomitrella patens
atggcggaccgttatgatagaaatccgtttgatgaggcggaggaagaagtgaatccgttctctacctcaagattaatgagatacttcagcaattcgagtgtcgcttctttgttctttttttttttgctgaagttttcgatgtgtgaacaggactacaagaagaaggagaaagagctgaaagccaaggaagaagaattgaggagaaaagagcaagagttgaaacgcagggaggatgctgttgcaagagctggcgtttcgatagagtctagaaactggccacctttcatccacattcttcatcatgatatcgctaatgatattccagcacactcgcggggattgatgcgctgggcttatgcaagttggttaggaattctactctgtctcttttggaacttcgtttgcgtgctttcagcgcttattgctaatgttggtggtgtgcagattcttcttcttggtattatttacgtgctggctggttatcccatgtcgtattttttgtggtataggcctctctaccgggcaatgaggtccgatagtgttctgagatttggttggttcctgatattctatctgctccacattgcattttgtgtgttggctgctgttgctccgcccatcatcttcaaaggaaagtcacttgcgggaatcataccagcgcttgaccttttctctcagaagctcattattggcatcttttatatggttgggtttgccttgtacacactggaaacacttctcagcatctgggttttaaagagtgtcacgcaatatttcagaggcgaaggaagagcagctgatatgaagcgagaggctgaagcgggtgcttttagatcagctgtttgatttagttgcactcttattgatagaccagagtttcattgtttaaatatctcttgtagagatttgcagtttgttaggaaagcttgcattggcacagattgtgttgctgaagttcagtatgaaatacggacagtagtgagggttttt

SEQ ID NO: 143 - protein, 289 aa, Physcomitrella patens
MAGRYDSNPFDEEEQVNPFSERLNAIQDPNSGLSHLPHEPVFSEVNDATVDIPLGGSKEMKNKEKELKAKEEELKRREKELKRREDAASIAGIVIESRNWPPLVPILHHDIANDIPEHVRGLMYRAYASWLGILLCLLWNFICVTAAWIAGASGVEILFLGFIYMLAGFPMSYFLWYKPLYRAMRTESVLKFGWFLVFYLLHISFCVLAAVAPPIIFKGKSLAGLIPAIDLFGKKLIVGILYAVGFGLYTLEVFLSVWVLKNVSQYFRGEGRAAEMKREAAAGAFRSAI

SEQ ID NO: 144 - DNA, 1433 bp, Physcomitrella patens
tgcgcgggatcagcaacgctcatttgttttggcttccagttttcgtttgtattttctgcgtctgcgtctacgtctgcgttttcgtctgcacttctctgtctgtaaacggatattggcgcaggttttccagtcatttttcttgcgggacttgcaggggtaggagagtgggagagcattgtgtggcgttgcggagtgaattggtggcgacaatttttttgcatccaaaaatcgctgctgagtggagatggcgggacggtatgatagtaatccgttcgacgaagacgaagtgaatcccttctctgatccagtggtgcgagctcaggccgggaaatcatcttatggcgggggctttttcgacaagaatgtgccacaggttaccacaatgtcaccacttccgcatgagccaattttttccggctcagtagcttcaaatgaagcaacagtagatataccccttggtggttcgaaagagttgaagcagaaggagagagagttgagggccaaggaggaagaactaaagaaaagagagaaggagctaaaacgcagagaggaagctgcagcaaaagctggtattctcattgaggacaaaaattggccaccgtttgttccaattcttcatcacgacattgctaatgacataccagcacatactcagcaactacagtaccacgcttattggagctggttaggaattttattttgcctattgtggaacttcatctgcacaacagtagcttggattgctggacctggtgacgtgttaatatggcttatgggtataatcttcgtgttagctggctatcctggttcttacttcttgtggtataggccactttatcgtgcgatgaggtctgacagtgccctgaagttcggttggttcttcctcttctattgtctccatattggtttcgttggattggctgcagttgctccaccaattttctttaagggaaaatctcttgcgggactgtggcctgccatcggcttatttggagataacgttctagttgctattttttatgtgttgggttgcgtctttttctcacttgagttgttgttgagtatctgggttattaaggaagtgtatgattacttcagaggctccggtaaagcagcgcaacttaagcgagaagctgcaggtggtgctttcagagctgctatatgatttgacacatctaagtagactggtccgaagtatttcgtgtatattggatgtaagttcgtcattgatcttgattagatgtttccatcaaattaaactgactggcggggagttttgcagtgtatctaaggattttgtagtgaacagtacaaggtaaaactaatagtgtgattagccaatgctttatttacctgttcgtaattgtatttccgtacgctgatatggttcagcttcaaactcccctaactgaatttcttgaaatttgtattgg

SEQ ID NO: 145 - protein, 281 aa, Physcomitrella patens
MADRYDRNPFDEAEEEVNPFSTSRLMRYFSNSSVASLFFFFLLKFSMCEQDYKKKEKELKAKEEELRRKEQELKRREDAVARAGVSIESRNWPPFIHILHHDIANDIPAHSRGLMRWAYASWLGILLCLFWNFVCVLSALIANVGGVQILLLGIIYVLAGYPMSYFLWYRPLYRAMRSDSVLRFGWFLIFYLLHIAFCVLAAVAPPIIFKGKSLAGIIPALDLFSQKLIIGIFYMVGFALYTLETLLSIWVLKSVTQYFRGEGRAADMKREAEAGAFRSAV

SEQ ID NO: 146 - DNA, 1402 bp, Pisum sativum
gacccttcttctgtcattaagtctaaattccaaatacacctaaaactgctcccattttattatattcttttgttgttttctagacattctcttcccttgcataagaagattcaaatatttcaacctcatctcaacttcctcattcatcccaatctcctttctacacttctcatcaccgcttccattctcctctcatcttctcatggccggtcgttacgaccctaaccccttcgacgaagaacaagtcaaccccttttctaatcctagaagtgctgcctctgccacaaattcaagacctgcacctctaaatcctgatcgtgctgattataactatgggtttggaccgactgttgatatacctcttgatacatcaacggatgggaaaaagaaggaaagggatctccaagcgaaggaagctgaattgagaaaacgggaacaggaagtcagacgcaaagaagaagccattgcacgagctggaattgttattgaggagaagaactggccaccatttttcccaattattcatcatgatatcacaaatgaaattccaattcaccttcgaacattgcagtatgttgcatttttttcgttgttagggttagtgttgtgccttacatggaatgttgtatctgtcactgcagcttggattaagggagaaggtgtaaaaatatggtttcttgctattatctacttcatagcaggagttcctggagcatatgccctgtggtatcgaccattatatcgtgcatttaggactgacagtgctattaagtttggatggtttttcatgttttacctgcttcacattggattctgtatcttagctgcagttgctcctcccatagttttcaaaggaaaatccttgacaggcattctgtcagccatagatgtagttggtgactatactttggttgggattttctacttcattggatttggattcttctgtcttgaaacattgatcagcatctgggttatccagcaagtatatatgcacttccgtggtggtggtaagactgctgagatgaagagggaagctgcactaggagcaatgggggctgcactaagatgaagcactttgtgaaggcagtatgaatgtcctgtgtttggttgtgttgtaaattacttataggaattgtgataaaaatatttcattgagattttttgtttctggttctctcttgtttgatatgctacatgttacatgtatattataagcagaaaatgtagacattaaggggttggttaaaacatgctacattttatggagttatatatagttttgttgactagatctttcactttgtctggacacatgatgatatttctaattcaatgttgaaataatctgcactgtaataaatattcattatatttctaattcaatgttgaaataaaaaaa

SEQ ID NO: 147 - protein, 289 aa, Pisum sativum
MAGRYDPNPFDEEQVNPFSNPRSAASATNSRPAPLNPDRADYNYGFGPTVDIPLDTSTDGKKKERDLQAKEAELRKREQEVRRKEEAIARAGIVIEEKNWPPFFPIIHHDITNEIPIHLRTLQYVAFFSLLGLVLCLTWNVVSVTAAWIKGEGVKIWFLAIIYFIAGVPGAYALWYRPLYRAFRTDSAIKFGWFFMFYLLHIGFCILAAVAPPIVFKGKSLTGILSAIDVVGDYTLVGIFYFIGFGFFCLETLISIWVIQQVYMHFRGGGKTAEMKREAALGAMGAALR

SEQ ID NO: 148 - DNA, 1025 bp, Populus trichocarpa
tcagatctggtgattactcagtaagaactaatgagtcggtacgattcgaacccgttcgaagaagaagaagtcaatcctttcgctgatcaaggaggaaaggggaaaggatcagggcagtcaaattatggcggaggcgcgttttatatgcctaatcccggaagtgtcccccctgcaacttcaaggctttcaccccttcctcacgaaccttatgatcgtggtgcaaccatagatattccccttgattctggaaaagaattaaaagctaaggagaaggaactccaagcgaaagaggctgaattgaagaggagggaacaggaactaaaacggaaggaagatgcaatagcacgtgctggaattgtaatagaggacaagaattggccaccattttttccgattatccatcatgacattggaaatgaaataccaatccacctacagaagattcagtatgttgcattcacaacatttttgggtttatttgtctgtctttcatggaatattgtagctgttaccacagcctggataaaaggggaaggtccaacaatttggtttcttgctatcatctacttcatatcaggggttcctggaggctatgttatgtggtatcgccctctttatcgtgcaatgaggacagatagtgctctgaagtttggatggtttttgttggcttacctgctccacattggcttttgcatctttgctgctgttgcccccccaattgttttcaaggggaaatctcttgcgggtattttgcctgctattgatcttatgggcagccatgctttagttgggatattctactttattggatttggattcttctgcgttgaatcactcctcagtgtctgggttattcagcaagtctacatgtatttccgaggcagtggaaaagctgcagagatgaagcgggaggccgcaacaaggaccatgatggctgccctatgacaatgctccactggacaaaaatgctattcttggatggaactagaagactacgcttcttgcccaccttttcccttcataca

SEQ ID NO: 149 - protein, 304 aa, Populus trichocarpa
MSRYDSNPFEEEEVNPFADQGGKGKGSGQSNYGGGAFYMPNPGSVPPATSRLSPLPHEPYDRGATIDIPLDSGKELKAKEKELQAKEAELKRREQELKRKEDAIARAGIVIEDKNWPPFFPIIHHDIGNEIPIHLQKIQYVAFTTFLGLFVCLSWNIVAVTTAWIKGEGPTIWFLAIIYFISGVPGGYVMWYRPLYRAMRTDSALKFGWFLLAYLLHIGFCIFAAVAPPIVFKGKSLAGILPAIDLMGSHALVGIFYFIGFGFFCVESLLSVWVIQQVYMYFRGSGKAAEMKREAATRTMMAAL

SEQ ID NO: 150 - DNA, 941 bp, Populus trichocarpa
aaattggggatctgaaagaattcaagaactatgagtcgattcaacagcgaccctaaccctttcgatgaagaggaagaagtgaatcccttctcgaagggctcaagtgttcctgcagtaaaggcacgcattcctcctttggggcatgaaccaatgggatttgggcacaatgatgcaacagttgacattccgcttgatacaatgaatgactcaaagaaaaaggagaaagatcttgcatcttgggaagcagatcttaaaaggagggaaaaggaaatcaagaggagggaagatgctgttgctaagactggtatcaccccagatgataaaaactggccaccattttttcccatcatccatcatgatatagcaaatgaaatacctatccatgctcaaaggctacagtatttggcttttgccagttggttaggtatagttctatgtcttgtcttcaatttaattgctgtgacagtatgttggattagaggtggaggtgtcaaaatttttttccttgccgtaatctatgtgctgatgggatgtcctctttcatatatcctatggtacaggcctctctatcgagcaatgaggcaagctttggcagaactgacggatagcgcattaaagtttggctggtttttcttgttctacctgatacatattggtttctgtatatttgctgctattgctcctccaattgtcttccatgggaagtcactgacgggcatccttccagcagttgatgtcatttctgatcatttgttggtcgggattttctacctggtagggtttggcctgttttgcttagagtcacttcttagcttgtgggtccttcagaaaatttatatgtatttcagggggcataagtgagaatttaggcgtgggactcgattcagtttttcaagtgttgctgcttcgcggggtggtttagtatattcctttttctatag

SEQ ID NO: 151 - protein, 276 aa, Populus trichocarpa
MSRFNSDPNPFDEEEEVNPFSKGSSVPAVKARIPPLGHEPMGFGHNDATVDIPLDTMNDSKKKEKDLASWEADLKRREKEIKRREDAVAKTGITPDDKNWPPFFPIIHHDIANEIPIHAQRLQYLAFASWLGIVLCLVFNLIAVTVCWIRGGGVKIFFLAVIYVLMGCPLSYILWYRPLYRAMRQALAELTDSALKFGWFFLFYLIHIGFCIFAAIAPPIVFHGKSLTGILPAVDVISDHLLVGIFYLVGFGLFCLESLLSLWVLQKIYMYFRGHK

SEQ ID NO: 152 - DNA, 1007 bp, Populus trichocarpa
aaattagggatctgaaagaggtcaagaaatatgagccgatacaacagcgaccctaacccattcgatgaagaagaagaagtgaatcccttctcgaagggcgcggttgctccggcatcaaaggcacgcattcctcctttgggacatgaagctatgggatttgggcacaatgatgcaacagttgacattccacttgatacaatgaatgattcaaagaaaaaggggaaagacctcgcatcttgggaagcagatcttaaaaggagggaaaaggaaatcaaaaggagggaagatgctgttgctaaaagcaaggactacaacctacaaatttttttgcttctaaaatcgtatatttatggatttgtagaatgtttattgctaactcaatttttcttttccattttacatggtatttcagctggcattaccccgaatgataaaaattggccaccttttttccctatcatccatcatgatatagcaaatgaaatacctatccatgcccaaaggatacagtatttggcttttgccagttggttaggtattgtcctttgtcttgtcttcaatgtaattgctgtgacagtgtgttggattagaggcggaggtgtcaaaatctttttccttgccataatctatgcgctgatgggatgtccactttcatatgtcttatggacggatagcgcattgaagtttagctggtttttcgtgttctacctgattcatattggtttctgtatatttgctgctattgctcctccaattgtcttccatgggaagtctttgacgggcatccttccagcagttgatgtcttctctgaccatgtgttggttgggattttctacttagtagggtttggcctgttttgcttagagtcacttctcagcttgtgggtccttcagaaaatctatatgtacttcagggggaacaagtgagagataatgtagggttggaactcggatacagtttttcaagtgttgctgcttctcacttctctgggtggtttggtagattc

SEQ ID NO: 153 - protein, 298 aa, Populus trichocarpa
MSRYNSDPNPFDEEEEVNPFSKGAVAPASKARIPPLGHEAMGFGHNDATVDIPLDTMNDSKKKGKDLASWEADLKRREKEIKRREDAVAKSKDYNLQIFLLLKSYIYGFVECLLLTQFFFSILHGISAGITPNDKNWPPFFPIIHHDIANEIPIHAQRIQYLAFASWLGIVLCLVFNVIAVTVCWIRGGGVKIFFLAIIYALMGCPLSYVLWTDSALKFSWFFVFYLIHIGFCIFAAIAPPIVFHGKSLTGILPAVDVFSDHVLVGIFYLVGFGLFCLESLLSLWVLQKIYMYFRGNK

SEQ ID NO: 154 - DNA, 1031 bp, Populus trichocarpa
ttggagtctctcttcaccttggtttctgcgatggctggtcggtacgatcctaacccttttgatgaagaagaagttaaccctttctctgacccagctgtgagatcgaaagcatcagggcaatcgaagtatggtgggcgtgcatttaacacagcaagtgcccctcctgcatcaaactcgaggctttcaccacttcctcctgaacctgctgacttttacaattacggcaatacagttgacattcctattgatgcacctgcggacttaaggaagaaagagaaggaacttcaagctaaggaggctgaactgagaaggcgggagcaggaggtgaagaggagagaagatgcagctgctagagctggaattgtcctggaagagaaaaattggccaccatttttcccaattatccatcatgatattgcaaatgaaataccagttcatctacagaaaattcaatatgttgcgtttacaacatttctaggaatggctttttgtcttttctggaatgtcatatctgttacaacattatggattaaaggaggaggggtaaacatctggtttctttctgttatctacttcatagcaggagttcctggagcttatgttctgtggtatcgtccactctatcgtgcatttaggactgagagtgctatgaggttcggatggtttttcatgttttatgcgcttcacattggcttctgcatctttgctgctgttgctccacctatagttttcaagggaaagtctctcactggtatcctggctgcagtcgatgttgtcggtaaacatgctttagctgggatcttctacttcatcggattcggttgtttctgtcttgaatcactgctgagcatctgggttattcagcaagtaggcatgtacttccgtggaagtggtaaagctgccgagatgaagcgggaagctgcaagaggagcattgagggcagcaatttgattccatggctctaggaagaaagcatcatggcggaccttgtgtggagttaggttgtaaattccattagctgcatgaaattg

SEQ ID NO: 155 - protein, 306 aa, Populus trichocarpa
MAGRYDPNPFDEEEVNPFSDPAVRSKASGQSKYGGRAFNTASAPPASNSRLSPLPPEPADFYNYGNTVDIPIDAPADLRKKEKELQAKEAELRRREQEVKRREDAAARAGIVLEEKNWPPFFPIIHHDIANEIPVHLQKIQYVAFTTFLGMAFCLFWNVISVTTLWIKGGGVNIWFLSVIYFIAGVPGAYVLWYRPLYRAFRTESAMRFGWFFMFYALHIGFCIFAAVAPPIVFKGKSLTGILAAVDVVGKHALAGIFYFIGFGCFCLESLLSIWVIQQVGMYFRGSGKAAEMKREAARGALRAAI

SEQ ID NO: 156 - DNA, 1025 bp, Populus trichocarpa
tgttaagatctggtgatttttcactagaaaatgagtcggtacgattcgaatcctttcgatgaagaagaggtcaatcctttcgcggatcaaggaggaaaggggaaaggatcagggcaatcaaattatggcggaggcgcgttttatatgcctaatcctggaagtgtcccccctgcaacttcaaggctttcaccccttcctcatgaaccctatgatcgtggtgcaaccatagatattcctcttgattctggaaaagatataaaagccaaggagaaggaactccaagctaaagaggctgaattgaagaggagggaacaggaactaaaacggaaggaagatgcgatagcacgggctggaattgtaatagaggataagaactggccaccattttttccgattatccatcatgacattggaaatgaaataccaatccacctgcagaagatgcagtatgttgcatttacaacattgttgggtttatttgtctgtctttcttggaatattatagctgttaccacagcctggatcaaaggagaaggtccaacgatatggtttcttgccatcatctacttcatagcaggggtccctggaggctatgttatgtggtatcgccccctttatcgtgcgatgaggacagatagtgctctgaagtttggatggtttttctttgcttacctgtttcacattggcttttgcatctttgctgctgttgctcccccaattgttttcaaggggaaatctcttgcaggtattttgcctgctattgatcttatgggcaaccacgctttagttgggatattctacttcattggatttggattcttctgtgtggaatccctcctcagtatctgggtcattcagcaagtctacatgtatttccgaggcagtgggaaagcagcagagatgaagcgagaggctgcaacaaggaccatgatggctgccctatgacattgctcccactggacaaaaatgctcttcttggatggtaccgaaagacctacttccatactaaacgcgtcttgcttcat

SEQ ID NO: 157 - protein, 304 aa, Populus trichocarpa
MSRYDSNPFDEEEVNPFADQGGKGKGSGQSNYGGGAFYMPNPGSVPPATSRLSPLPHEPYDRGATIDIPLDSGKDIKAKEKELQAKEAELKRREQELKRKEDAIARAGIVIEDKNWPPFFPIIHHDIGNEIPIHLQKMQYVAFTTLLGLFVCLSWNIIAVTTAWIKGEGPTIWFLAIIYFIAGVPGGYVMWYRPLYRAMRTDSALKFGWFFFAYLFHIGFCIFAAVAPPIVFKGKSLAGILPAIDLMGNHALVGIFYFIGFGFFCVESLLSIWVIQQVYMYFRGSGKAAEMKREAATRTMMAAL

SEQ ID NO: 158 - DNA, 1424 bp, Solanum lycopersicum
gtctttctaccactctagaattgtagtggaattttctttcttcttgtttttctcattcaaactactatagttttcaagactctgcctttttcccccttctctgcttagccttttccacctattttttgctattcagatctcaagttttacactttgctttccctctgtaaatttcttgttttgtggcaaaattcagaaagtagcaaagttttcttgaaatggccggccgttatgatcataacccttttgaagaagaagaagaagttaacccttttgctgatggcggaggcagagggaaatcttcagggcaatcaaaatttagtggaggtgcattttataccacatccgggagtgtgcctccagcaacaaactccagactttcaccccttccgccagaaccagctgatttctatgaccgcaatgcgtcaattgatattcctcttgacagtgcttcggacctgaaaaagaaagaaaaagaattacagtctaaggagaatgaattgcggaggagggaacaggatctaaaaaggagagaagatgctgctgcacgagccggcattgttctcgaggagaaaaattggcctccgttcttcccaatcatccatcatgatattgcaaatgaaataccaattcatcttcaaaagctacaatatgttgcatttacaacgttcttgggacttattgcatgcctattatggaacattgtagctacaactacagcatggattaaagaaggagatgtgaagatctggttcctttctatcatatacttcatatcaggtgttcctggagcctacttcatgtggtatcgtcctctgtatcgtgcgtttagaactgagggtgccaagaagtttgcgtggtttttcttggttttacttgggtcacattgtattttgcgtctttgctgctgttgctcctccagtagtcttcagaggaaaatcccttacaggcatcctgcctgcggtggatctcatcggcaaaaatgtacttgttgggattttctacttcatcggttttgggttattttgtctcgagtcattgctgagcatttgggttattcagcaagtatacatgtatttccgaggaagtggtaaagccgcgcagatgaagcaagaagctgctagaggtgcccttagagcagcaatataattgaaagaaatgttcttggtagaaggctgttaaatatgcttttggtgattatatgttttagttagttcaatttgacatatatgctgcttgttttgcatatgcttttggtgattatgcttttatttatgactacttagaccaaagtgctgttaggaaaaagatttagaattccttttgtttaattggagacacaatctatattatgtttatattgatatttttgtcatactcatttcttgtaatatgtttcttctgaaaatcaaacattcttctcc

SEQ ID NO: 159 - protein, 291 aa, Solanum lycopersicum
MAGRYDHNPFEEEEEVNPFADGGGRGKSSGQSKFSGGAFYTTSGSVPPATNSRLSPLPPEPADFYDRNASIDIPLDSASDLKKKEKELQSKENELRRREQDLKRREDAAARAGIVLEEKNWPPFFPIIHHDIANEIPIHLQKLQYVAFTTFLGLIACLLWNIVATTTAWIKEGDVKIWFLSIIYFISGVPGAYFMWYRPLYRAFRTEGAKKFAWFFLVLLGSHCILRLCCCCSSSSLQRKIPYRHPACGGSHRQKCTCWDFLLHRFWVILSRVIAEHLGYSASIHVFPRKW

SEQ ID NO: 160 - DNA, 1313 bp, Solanum lycopersicum
gcttttgtctctgctgtcatctcgtgaatgaatagctacatttggtaacgtgcagtgcaatttctactggcaaaaagaagaagaatatttaagcagaagcaaattcaggggaaaaaagtagtaaagatatcacgtctatttcataaaaaaggtgtatacatattggaaatctaaaacccaagttgttcaagattttagatttgagcttgtttgaacatatccagatctgtggaagaggcgatggctggtcgttacaatgacaatccttttgctgaagaagatgaagtgaacccattttcgaataatggaagtgttcctgctgcttcaaactcgaggccttatcctcttcctcatgaacctgctggctatgatcgtggcgcaaccgttgatattcctcttgatggttcaaatgatatgaagaagaaagagaaagaactccaagctaaagaggctgaattaaagaaaagagaacaggaacttaaaaggaaggaggatgcaataacaagagctggtgtagtgattgaagacaagaattggccacctttcttccccatcattcatcacgatatcgcaaatgaaattcctattcatcttcagaagttgcaatatgttgcattcactacactgttgggtctggcagcctgtcttgtatggaaccttgttgctgtcaccttagcttggatcagaggagaaggtccaactatctggttgcttgctgttatctacttaatatcaggtgtcccaggagcctatgtattgtggtatcggcctctctatcgtgcgatgaggactgatagtgcgctgaagtttgggtggtttttcttaagttacgtgtttcacatcggattctgcatcattgctgctgtggcacctccaattttcttcaagggaaaatctttgactggtatcttgcctgcaattgatcttttaggctggcatgctttggttgggatattctacttcattggagctggattcttctgtcttgaaacattgatgagcatatgggttatacagcaagtctacatgtatttccgcggaagtggaaaggctgcagagatgaagaaagaggctgcaagatcgactatgatggctgcactatgacgacattattgtagggtcattcaagcatatgcagttttggtcttcgtgtttgttaaattctttgattgctttcatcactacaacttacctaaatgatgcaaatgtaattctggagtacatagtgatatcaattgagtaacacttgaacagactcatgttatgtggacatttatagtaatttgatgctcattgtgccatttttctgaatt

SEQ ID NO: 161 - protein, 287 aa, Solanum lycopersicum
MAGRYNDNPFAEEDEVNPFSNNGSVPAASNSRPYPLPHEPAGYDRGATVDIPLDGSNDMKKKEKELQAKEAELKKREQELKRKEDAITRAGVVIEDKNWPPFFPIIHHDIANEIPIHLQKLQYVAFTTLLGLAACLVWNLVAVTLAWIRGEGPTIWLLAVIYLISGVPGAYVLWYRPLYRAMRTDSALKFGWFFLSYVFHIGFCIIAAVAPPIFFKGKSLTGILPAIDLLGWHALVGIFYFIGAGFFCLETLMSIWVIQQVYMYFRGSGKAAEMKKEAARSTMMAAL

SEQ ID NO: 162 - DNA, 1076 bp, Triticum aestivum
  misc_feature (15)..(15): n is a, c, g, or t
cgacgacccacgctnccgcacgtaaataacccccccgtctgtcgaaaaagccgaagtccaaagcagttggtcgctcgctccctcgcccgccaccgccgcgttggacttttccctcgccggagaaaccgccgcgaccacagccgcaaccgccgccaccgcctccggaggaggaggaggaggaggagtagtactaccagggagggaggaggccatggcggggaggtacgaccgcaaccccttcgacgaggatgacgtcaaccccttcgcgggaggaggtgtaccccctgcttctaattctcggatgccaccccttcctcacgaacctgctggattctataatgatcgcgctaccgtggacatacctcttggttcatcgaaggacttaaagcaaaaggagaaagaactgcagtcgaaggaggctgagcttaacaaacgggaaagagaacttaaaagaagggaagaagctgcagctagagctggtattgtcattgaaacgaaaaactggccaccatttatgcccatcattcatcatgacatttcaaatgagataccaatccacctacaaaggatgcagtaccttgcattttgttcattgttgggattgacgttatgcctcttttggaacatcattgcaactaccgcagcatggattaaaggggcaggtgttgtcatctggttgctagcaattatctacttcatctctggtgtccctggggcctatgtgctatggtatcggccgctttataatgcaatgaggactgaaagcgctctgaagtttggatggtttttctgctgtacttgatccatataatattctgcatctggtcagctgtgtctccccccattcctttcaagggaaatctatcgctgggttttgccggcaatgacgtctaggcagcaacgctttgtgggatatttactttgtgggattcgactgtctgccttgagccatgctagcatggtgtcatccagcagtttcctgtctcccgggaatggaagctgccaaataagcagaggaccagtgtctattaatctgctcgataacggccccctataatgataaaatgattccatcg

SEQ ID NO: 163 - protein, 196 aa, Triticum aestivum
MAGRYDRNPFDEDDVNPFAGGGVPPASNSRMPPLPHEPAGFYNDRATVDIPLGSSKDLKQKEKELQSKEAELNKRERELKRREEAAARAGIVIETKNWPPFMPIIHHDISNEIPIHLQRMQYLAFCSLLGLTLCLFWNIIATTAAWIKGAGVVIWLLAIIYFISGVPGAYVLWYRPLYNAMRTESALKFGWFFCCT

SEQ ID NO: 164 - DNA, 1084 bp, Triticum aestivum
tatacggcgacccacgcgtccgcgactggagcacgaggacactgacatggactgaggagtagaaaagaccaaaccaccgatcatttccacccgacgcttccaccacccgaatccagccagccagccagccagccagccaggcgaagctgcgaggatgtaccgagatcccaaccccttcgacgagggcgccgacgacaacgccttctccaatgggggaggacgcggtggtgctggtggtggcggcggcggcggcaagtcgcagttccagtttcgcccgacggagcccgtcggattcggcgccggcggcaacggggacgccgccgtcgacatcccccttgacaacatgaacggttcgaatggcaaggaaagtgagctctcacagtggcaggcagatctcaagaggcgagaggcggacatcaagaggagggaggaagctctcaagagcgctggggtgcccatggaggacaagaactggcccccgttcttcccgatcatccaccacgacattgccaatgaaataccagccaacgcgcagcggttgcagtatcttgcttttgctagctggctcggcatcgtgctttgcctcgtttggaatatcattgctgtcacagtctgttggatcagagggggagactctaaactgtttttcctggctactatctatggtatgcttggagtacctttgtcctacttgatgtggtataggcctctgtaccgtgcaatgagaactgacagcgcattcagctttgggtggattatcctttgttacatgctccacattggcttttgtataattgctgccattgctccgccaatcgtatttcgtgggaggtcatttacgggtatactgcctgcaatcgataccttctctgatcatgcataagtggggatactctactttgtcggaatttgccttgtttccatgggagacaggtgtgaccatttggggtcttcagagagtatacatgtttttcagagggcacaattgaagcgggaatgggagaaagtcagaaatccaccggtgtcttggacctgctggggtcttggcatcctattaagtaatgccaccctggatgtatggcaa

SEQ ID NO: 165 - protein, 309 aa, Triticum aestivum
MYRDPNPFDEGADDNAFSNGGGRGGAGGGGGGGKSQFQFRPTEPVGFGAGGNGDAAVDIPLDNMNGSNGKESELSQWQADLKRREADIKRREEALKSAGVPMEDKNWPPFFPIIHHDIANEIPANAQRLQYLAFASWLGIVLCLVWNIIAVTVCWIRGGDSKLFFLATIYGMLGVPLSYLMWYRPLYRAMRTDSAFSFGWIILCYMLHIGFCIIAAIAPPIVFRGRSFTGILPAIDTFSDHAVGILYFVGICLVSMGDRCDHLGSSESIHVFQRAQLKREWEKVRNPPVSWTCWGLGILLSNATLDVWQ

SEQ ID NO: 166 - DNA, 1352 bp, Triticum aestivum
gtaaataacccccccgtctgtcgaaaaagccgaagtccaaagcagttggtcgctcgctccctcgcccgccaccgccgcgttggacttttccctcgccggagaaaccgccgcgaccacagccgcaaccgccgccaccgcctccggaggaggaggaggaggaggagtagtactaccagggagggaggaggccatggcggggaggtacgaccgcaaccccttcgacgaggatgacgtcaaccccttcgcgggaggaggtgtaccccctgcttctaattctcggatgccaccccttcctcacgaacctgctggattctataatgatcgcgctaccgtggacatacctcttggttcatcgaaggacttaaagcaaaaggagaaagaactgcagtcgaaggaggctgagcttaacaaacgggaaagagaacttaaaagaagggaagaagctgcagctagagctggtattgtcattgaaacgaaaaactggccaccatttatgcccatcattcatcatgacatttcaaatgagataccaatccacctacaaaggatgcagtaccttgcattttgttcattgttgggattgacgttatgcctcttttggaacatcattgcaactaccgcagcatggattaaaggggcaggtgttgtcatctggttgctagcaattatctacttcatctctggtgtccctggggcctatgtgctatggtatcggccgctttataatgcaatgaggactgaaagcgctctgaagtttggatggttttttctgctgtacttgatccatataatattctgcatctggtcagctgtgtctcccccatttcctttcaaaggaaaatctatcgctgggtttttgccggcaattgacgtcataggcagcaatgttattgtggggatattttactttgttggattcggactgttctgccttgaagcactgctcagcattgtggtgatccagcaagtatacatgtacttccgtggaagtggaaaggctgcgcagatgaggcaagaggcagcacgtggtgccatgagatcggccttctgatagagcggtctcgctgatgaatggatgagaataggatgtgccaatcgttgatggcgtcttgtctttgtacattcctatacatatctgtgggtggctgagagagaatacctgtagctatagatcttcttgcattcttgtaatatatacgagtgcttcatttctttcctaggccccagatccatgtgctttatatgtagcttaatcttttgggagatacaacttccaccatcactatcctgacgagcttgcttgcaatgtcactatattatggttaatgtatgtgaagtgctaaaactagttt

SEQ ID NO: 167 - protein, 286 aa, Triticum aestivum
MAGRYDRNPFDEDDVNPFAGGGVPPASNSRMPPLPHEPAGFYNDRATVDIPLGSSKDLKQKEKELQSKEAELNKRERELKRREEAAARAGIVIETKNWPPFMPIIHHDISNEIPIHLQRMQYLAFCSLLGLTLCLFWNIIATTAAWIKGAGVVIWLLAIIYFISGVPGAYVLWYRPLYNAMRTESALKFGWFFLLYLIHIIFCIWSAVSPPFPFKGKSIAGFLPAIDVIGSNVIVGIFYFVGFGLFCLEALLSIVVIQQVYMYFRGSGKAAQMRQEAARGAMRSAF

SEQ ID NO: 168 - DNA, 1356 bp, Triticum aestivum
ccacgcgtccgaccgcgtcacgtaaataaccccccgtttgtcgaaaaagcggaagtccaaagcagttggtcgctcgctccctcgctcgccaccgccgcgttggacttttccctcgccggagaaaccgccgcgaccacagccgcaaccgcagccaccgctttcggagggggaggaggagaagtaggagtagggagggaggaggccatggcggggaggtacgaccgcaaccccttcgatgaggacgacgtcaaccccttcgcgggaggaggtgtaccccctgcttctaattctcggatgccacctcttcctcacgaacctgctggattctataatgatcgtgccgctaccgtggacatacctcttggttcatcgaaggacttaaagcaaaaggagaaagaactgcaatcaaaggaggctgagcttaacaaacgggaaagagaacttaaaagaagggaagaagctgcagctagagctggtattgttattgaaacgaaaaactggccaccttttatgcccatcattcatcatgacatttcaaatgagataccaatccacctacaaaggatgcagtaccttgcattttgttcattgttgggattgacattatgcctcttttggaacatcattgcaactaccgcagcatggattaaaggggcaggtgttgtcatctggttgctagcaattatctacttcatctctggtgtccctggggcctatgtgctatggtatcggccgctttataatgcaatgaggactgaaagcgctctgaagtttggatggttttttctgctgtacttggtaacaaccttgccatctaatccatataatattctgcatctggtcagctgtgtctcccccatttcctttcaaaggaaaatctatcgctgggtttttgccggcaattgacgtcataggcagcaacgctattgtggggatattttactttgttggattcggactgttctgccttgaagcactgctcagcattgtggtcatccagcaagtatacatgtacttccgtggaagtggaaaggctgctcagatgaggcaagaggcagcacgtggtgctatgagatctgccttctgatagagcggtctcgctgatgaatggatgagaataggatgtgccagtcggtgatggcgtcttgtctttgtacatccctatacatatctgtgggtggctgagagagaatacctgtagctatagatcttcttgcattcttgtaatatataggagtgcttcattccttttctaggccccagatccatgtgctttatatgtagcttaatcttttgggagatacaacttccaccatcactattctgacgagcttgattgccaatgtcactatatta

SEQ ID NO: 169 - protein, 233 aa, Triticum aestivum
MAGRYDRNPFDEDDVNPFAGGGVPPASNSRMPPLPHEPAGFYNDRAATVDIPLGSSKDLKQKEKELQSKEAELNKRERELKRREEAAARAGIVIETKNWPPFMPIIHHDISNEIPIHLQRMQYLAFCSLLGLTLCLFWNIIATTAAWIKGAGVVIWLLAIIYFISGVPGAYVLWYRPLYNAMRTESALKFGWFFLLYLVTTLPSNPYNILHLVSCVSPISFQRKIYRWVFAGN

SEQ ID NO: 170 - DNA, 958 bp, Triticum aestivum
tgggacatcagggttatcagtatgtcacactgcaacctgcatggttattgctggcattgtcatagaagacaaaaactggccaccctttttccctctcattcatcacaatatttcaaatgagatacccatccatctacaaaaaatgcagtaccttgcattttcatcatttttgggaattgctctctgcctcttctttaatatcatagcgactacaactgcatggattaagggagaaggtgtcatggtttggttgcttgccattatctacttcatatctggtgtccctggggcttatgtgttatggtatcgccctctttataatgcgatgagaactgagagtgctttgaagtttgggtggtttttcctattttacatgattcacataatcttctgcgtgtggtcagctgtgtctcccccattccctttcaaaggaaattctttgactgggattttgcctgccattgatgtcataaccaagagccttattgttgggatattttactttgttggatttggattgttctgccttgaatcactgctgagcataggtgtcattcagcaagtgtacatgtacttccgtggaagtggaaaatcccaggagttgaaacaacaggcagcacgtggtgccctgagctctgcgttctgatgaagaaaaccagcagccagagttgtagccagggtagtgagtggaaggagacaggatgtgtgccgattggaaatggtagtcttgcgcatcgctgcaccatgcggatttggatcgctgaaatcatacagctatatctttttgctcttctgttaatacaaatataaggagccttctcgtgtggatacttttaaggtggtgttgtttccattcgttgacatggttttagatgtggttgatagcgaggaccgactaatattcttggtggaatatatttgcatatgcttgtgcgggagtaaatttacttgttcattt

SEQ ID NO: 171 - protein, 201 aa, Triticum aestivum
MVIAGIVIEDKNWPPFFPLIHHNISNEIPIHLQKMQYLAFSSFLGIALCLFFNIIATTTAWIKGEGVMVWLLAIIYFISGVPGAYVLWYRPLYNAMRTESALKFGWFFLFYMIHIIFCVWSAVSPPFPFKGNSLTGILPAIDVITKSLIVGIFYFVGFGLFCLESLLSIGVIQQVYMYFRGSGKSQELKQQAARGALSSAF

SEQ ID NO: 172 - DNA, 1124 bp, Triticum aestivum
gcacgaggatgcatcacgaccccaaccccttcgacgagggcaccgccggcgacgagaaccccttctccaatggcggaggccgcggcgggaagaagcagtacggcttccggcccaccgagcccgtcggcttcggcggcggcggcggcagcaggggcgacgccaccgtcgacgtgcccctcggcaacatgggcgactcgaatggcaaggcgagggagctctcgtcgtgggaatcagatctgaggcggcgtgaggcggatatcaaaaggagggaggaatcactgaagaatgctggagtgcccatggaggacaagaattggccgccatttttccccattatccaccatgacatcgccaatgagataccggccaacgtgcagaagctacagtatctggcgttcgcaagctggcttggaattgtgctctgcctctcctggaactttattgctgtcatagtctgctggatcaaggagggagattcaaagctgttcttccttgctacaatctatgctttgcttggaattcccctttcttacttgatgtggtatagacccctctatcgtgcaatgagaactaacagtgcattcagttttggatggtttttcctgtgttacctgatccacattggtttttgcataattgctgccattgctccgccaatcgtattccaagggaaatcattaacgggcatattggctgcgatcgacactttctctgagcatgtgataattgggatcttttacttcgtggggtttgcactattttgcttggagacactgctgagcatcggggttcttcagaaagtatacatgtacttccgagggcataagtgaagctagtcgtgatggaaatttttcagaagcctacaagcagtagtgattctgtccatatgtgttagtacaccttgagtctatgtttgttgagcgaagggttatcgaagaatgcttctgagactgagtggagtatggcatgtagcgctgctactataggatcttctctaagatgggggtgctgaggttctttatatgctgtgcttcgtgtgtcatctggtagttcgtttgggagtctggcatgtaggcgaacattacagtactcagtattcattattaaccgaagaagagcaacta

SEQ ID NO: 173 - protein, 273 aa, Triticum aestivum
MHHDPNPFDEGTAGDENPFSNGGGRGGKKQYGFRPTEPVGFGGGGGSRGDATVDVPLGNMGDSNGKARELSSWESDLRRREADIKRREESLKNAGVPMEDKNWPPFFPIIHHDIANEIPANVQKLQYLAFASWLGIVLCLSWNFIAVIVCWIKEGDSKLFFLATIYALLGIPLSYLMWYRPLYRAMRTNSAFSFGWFFLCYLIHIGFCIIAAIAPPIVFQGKSLTGILAAIDTFSEHVIIGIFYFVGFALFCLETLLSIGVLQKVYMYFRGHK

SEQ ID NO: 174 - DNA, 1248 bp, Triticum aestivum
ccacgcgtccgtgaaaagcagcaccaagaagggaacggactgcttggactggaagcgacccgcgtccaccaccgccgctttccccctcgccccctcaccgcgcggcgacgccgagcgacccagcggcgagcccggcatgcatcacgaccccaaccccttcgacgagggcaccgccggcgacgaaaaccccttctccaatggaggaggccgcggcgggaagcagcagcacggcttccggcccaccgagcccgtcggcttcggcggcggcggcagcaggggcgacgccaccgtcgacgtgcccctcggcaacatgggcgactcgaatggcaaggcgagggagctctcgtcgtgggaatcagatctgaggcgtcgtgaggcggatatcaaaaggagggaggaatcgctgaagaatgctggagtgcccatggaggagaagaattggccgccttttttcccgattatccaccatgacatcgccaatgagatacctgcaaacgtgcagaagttacagtatctggcgtttgcaagctggcttggaattgtgctctgcctctcctggaactttattgctgtcatagtctgctggatcaaggagggagattcaaagctgttcttccttgctacaatctatgctttgcttggaattcccctttcttacttgatgtggtatcgacccctctatcgtgcaatgaggactaacagtgcattcagttttggatggtttttcctgtgttacctgatccacattggtttttgcataattgctgccattgctccaccaattgtattccaagggaaatcattaacgggcatattggccgcgatcgacactttctctgagcatttgataattgggatcttttacttcgtggggtttgcactattttgcttggagacactgctgagcatcggggttcttcagaaagtatacatgtacttccgagggcataagtgaagcggtcatggatggaaaaatttcggaagtctacaagcagcagtgattctgttcatatgtgtcagtacaccttgagtctatgttctgttctgccaaaggttagcaaagaatacttctgagcctgaatggagtatgtaagggtagccctgctactatatgatgttctctaagatggggtgttgagattctttatatgctgtgcttcgtgtgttatctggtagttcgtttgggagtttggcatgtcggtgaacattacaagtaatcagtatttaaacgaagatgaacaactaggc

SEQ ID NO: 175 - protein, 272 aa, Triticum aestivum
MHHDPNPFDEGTAGDENPFSNGGGRGGKQQHGFRPTEPVGFGGGGSRGDATVDVPLGNMGDSNGKARELSSWESDLRRREADIKRREESLKNAGVPMEEKNWPPFFPIIHHDIANEIPANVQKLQYLAFASWLGIVLCLSWNFIAVIVCWIKEGDSKLFFLATIYALLGIPLSYLMWYRPLYRAMRTNSAFSFGWFFLCYLIHIGFCIIAAIAPPIVFQGKSLTGILAAIDTFSEHLIIGIFYFVGFALFCLETLLSIGVLQKVYMYFRGHK

SEQ ID NO: 176 - DNA, 1440 bp, Triticum aestivum
gtcaagtcgcaaagtcgtcgccgtcacacatatctggcccaactggtggggggcggtggcaagtgcaaccgtgcgtgcgctcctgtatccatctgtctgccgggactcatcgtctcctccttccccaatcgccattgtcggtggtgcaagcaagcgcgccgaggcgtgtgggagggacatggcggggcgctacgatggcggcaaccctttcgaggaggaggaggacgtgaaccctttctcggaacaaacgcgaggcaaagctggcgggcagtccaactatggcggcggcggcgcgttctacatgccaaatcccagaaacgttgccccctcctcgaattcgcggctttcgccccttcccccggaacctgcagatttcagtgccacagtggatatccctcttgagtcatcaaaggacctgaagaaaagagaaaaggagctgcaagcgagggaagcagagttgaacaagagggagaaggaattgaaaagaagggaggaagctgcagcacgagctggtattgtcatcgaggagaaaaactggcctccttttctgccactcatccaccatgacattgccaatgagataccgactcatcttcaaagaatgcaatacttcgcatttgcgtcatttcttggtttggtttgctgtctcttctggaatgtcgtagcagttacttcagcctggatcaagggggaaggtgtgaaaatctggttgctagcaataatctacttcatctctggggttcctggtgcatatgtgttatggtatcgccctctttataatgctatgaggactgacagcgcgttgaagtttggattgtttttcttgctctacttgtttcacatcgttttcgtcgtatttgctgccgtggctcctcccgctgtctttgagggcaagtctttggcaggaattttgccggcgattgatcttatcagtgtgaatgctctagttgggatcttctacttcattgggtttggattatttgccctggagtcattgttgagcatctgggttatccagcaagtgtacatgtacttccgaggaagtggaaaggccgcagagatgaagcgtgatgcgacaaggggcgctatgagagcggcattttgactgccacatatctcagatgatgataggtctcaagattaattccatggattagatggcaccataaacaaaagtatatgtttgccttggctctgactataatcttaagttggcataggatactgctgtgatgaagtgacattgtaggacttgtccacttttcttaccggtatagagaatgtgcagtttttacagattatgatccgtcctgaatataaacgctgtgtcctgagagagtaggtattaacaaggtaccgttgcgactatatcaatggtacccttgcgatctggcctatttgttgcagctttaccaatatatcattcggtttaaagaaaaa

SEQ ID NO: 177 - protein, 308 aa, Triticum aestivum
MAGRYDGGNPFEEEEDVNPFSEQTRGKAGGQSNYGGGGAFYMPNPRNVAPSSNSRLSPLPPEPADFSATVDIPLESSKDLKKREKELQAREAELNKREKELKRREEAAARAGIVIEEKNWPPFLPLIHHDIANEIPTHLQRMQYFAFASFLGLVCCLFWNVVAVTSAWIKGEGVKIWLLAIIYFISGVPGAYVLWYRPLYNAMRTDSALKFGLFFLLYLFHIVFVVFAAVAPPAVFEGKSLAGILPAIDLISVNALVGIFYFIGFGLFALESLLSIWVIQQVYMYFRGSGKAAEMKRDATRGAMRAAF

SEQ ID NO: 178 - DNA, 1160 bp, Triticum aestivum
  misc_feature (18)..(18): n is a, c, g, or t
  misc_feature (26)..(26): n is a, c, g, or t
  misc_feature (1144)..(1144): n is a, c, g, or t
gggcagacagcgcagggnatttattntgccttagggatcttctcaatgtctcctagcacctatccgctcgaagacgagaatgtcaatcctaccgcgaattggaaattatcagcaccagctccagcaaagaaatcatggatcccagcgggctttggaggcagtggcaagcatgacgccaccatcgacataccattatatgatccgaagaagcgggagcaagagctcttatcatgggaggaggatttgaagaggagggagcgggatatcatacagagggagaatgcaatgaacagagctggtgtcaccatcgaagtgaaaaattggccaccattctttcccgtcatacatcatgacatagccaatgaaataccaacccatgctcaccagttgcaatattcagcatttgctagctggctaggaattgttgtatgtctcagttggaatgtatttgctgtcttagttgaatcaattcacggggaagatattgttctttttctccttgccatcatctatgcggcatttggatgtcctctttcatacatcctatggtacagaccctctgtaccaggccatgagaactgatagcgtggtgacatttgcccagtttttcgtcttctactcggtgcatgttggattttgtgttattgctgcaattgctccgccgataatattcatggggaaaactcttacgggaattcttgtggctatcgatgttttaaacacggatatgtttgtcgggcaatgcagagagtatacatatattttcgagggcacaggtgaagcctagcaatgagacgatgaaatcattcagggcaactgtctcctcaacagcaagcattctgatgcaaaacacaaagttgacggtgaatgttagtgaactgcttctgccgaattcttgcatattcagacatacagtggaaattgatttaatctcatagtagaaatgtgaatcaagataacaagtactatttgattcaacatctccgaaacagaatggtggtaccagatcccatgcctgcaaaacttgcggcgtgtctcctgccgatgtgccaacggtgaagcgtgttagaaagttcaggcttatgcaggttctccggtcaaagatgaaagcatttaggatctcctttgtttttcatttgtatcnataaatctgtactgtt

SEQ ID NO: 179 - protein, 178 aa, Triticum aestivum
MSPSTYPLEDENVNPTANWKLSAPAPAKKSWIPAGFGGSGKHDATIDIPLYDPKKREQELLSWEEDLKRRERDIIQRENAMNRAGVTIEVKNWPPFFPVIHHDIANEIPTHAHQLQYSAFASWLGIVVCLSWNVFAVLVESIHGEDIVLFLLAIIYAAFGCPLSYILWYRPSVPGHEN

SEQ ID NO: 180 - DNA, 1670 bp, Zea mays
ccgttctagacgccatggacgatgcggcggcggcggcggtagataggcacggcggcttctagaccgtctccgttttctgcgcgttggccgtcgggggaagtacacaataaacaaagcaagagcagaggtgcaactgggctgctgcgtcctctgcctcttctccttcctgtcgttctgcgctgccccgacccccgagtgcccctggtcttgtcctcctctccctgctgacctcggagcggagcggagcaagcagccgccaggagggaaggatccatggccgggagatcgcggtacgacaaccccttcgaggagggcggcgccgacgaggtcaaccctttcgcggaccaagctaagagaggaggatcgagtgctcagtccggctactctggtggcgcgttctacacgacgcaatcgcaacgccctgctcctcctagcacacgcctttcgcctcttcctcctgaacctgccgacttctacaacgacttcgctaccccggtggatatccccatggacacaaacaaggacatgaagacaagggagaaggagcttctggccaaggaggccgagctgaacaggcgtgagaaggaaataaaaaggcgagaagatgctgcggcacgagctggtgtcgtgttggaagagaagaactggcccccgtttttccccatcattcataacgatatcggcaacgagatacctgtccatctgcaaagaacgctgtacgtcgcgttcgcgtcgctcttagggttggtcttgtgcctgttttggaacataatctgcgttaccgctgcctgggcaaaagggtcaggtccaaagatatggtttctcgcaatcatatacttcatcctcggatgccccggtgcatactacctttggtaccggccactataccgcgcaatgaggaacgagagcgctctcaagttcggatggtttttcctcttctacttggttcatatcgccttctgcgcgtacgcagctgtttctccttcaattctcttcgtgggaaaatcgttaaccgggattttgccagcaatcaacttgataggcgacagcgtcattgttgggatcttctacttcattggctttgcattgttctgcctggaggctttgctaagcgtgtgggtcattcagcgcgtctacctgtacttccgagggagcgggaaagaagcggagatgaggcgggaagcagcacgcggtgcggcgagggcagcgttttgatgaaaaccgtatatagatatatcatatatatatatatatcggcacgacatacatactgttcataatagtttgaagtgctttaggtcaacaggcatgtgtgtacagtagggttggcgtcctagggttagtttggtgaacataaaaatggagggaatctataaaggagagatccgttgttattcaaaattaaataacaagaggatccctcttccatagattccctctccattttcttgtccaccaaaccaaccctgagtttctattgccacggtgttttgagccgtccagattgatcaatcatgccacatatgacagtgttagtatatggagtaaatacacgggtaaacctagttagactctttgttccatatgtgcatttttgtgtcaccgctttgtatcaattatttatagacgtaataaagttgtaatgatgttctcaaaaaaaaaaaaaaaaa

SEQ ID NO: 181 - protein, 313 aa, Zea mays
MAGRSRYDNPFEEGGADEVNPFADQAKRGGSSAQSGYSGGAFYTTQSQRPAPPSTRLSPLPPEPADFYNDFATPVDIPMDTNKDMKTREKELLAKEAELNRREKEIKRREDAAARAGVVLEEKNWPPFFPIIHNDIGNEIPVHLQRTLYVAFASLLGLVLCLFWNIICVTAAWAKGSGPKIWFLAIIYFILGCPGAYYLWYRPLYRAMRNESALKFGWFFLFYLVHIAFCAYAAVSPSILFVGKSLTGILPAINLIGDSVIVGIFYFIGFALFCLEALLSVWVIQRVYLYFRGSGKEAEMRREAARGAARAAF

SEQ ID NO: 182 - DNA, 1244 bp, Zea mays
cgccactcgccgccatccgctccgcaggtcacgtgaaaagcagtgcaggcgcaagggcaccgccgaggcagaaaagggcggataaactgcttgaactggaagcgaccctagtccaaaccaccgcaccgacaccgactccgagccccgccgcgccgcgctacctccgctcctctcttcgcccctgccggcgtcgaggccgaagcgaaggcgagcatgcatcacgaccccaaccccttcgacgagggcagcgccgaggacaaccccttctcaaatggaggagccggaggcggcaagcagcagtacggcttccggccgactgagcccgtcgggttcggcggcgctagcaggggcgacgccgtcgttgacgtcccgctcgagaccatgggggactctcggagcaaggtgaaggagctctcgtcgtgggaatcagatctgaagcggcgagaggcggatatcaagaggagggaagaggcgctgaagaatgctggcgtgccaatggaggagaagaactggccaccattcttccccatcatccaccatgatattgccaatgagataccagcaaatgtgcagaagttgcagtatcttgcatttgcaagctggcttggaattgtgctttgtttgtcctggaacttcgttgctgtcatagtctgctggatcaaggagggagattcaaagttgtttttccttgcaacaatctatgctttgcttggaattcctctgtcatatttgatatggtacaggccactctaccgtgcaatgaggactaacagtgctttcagttttggatggtttttcctgtgttacctgatccacattggtttttgcataattgctgccattgctccaccaattgtatttcatgggaaatcattaactggtattctggctgcgattgacactttctctgaacatgtgataattgggatcttttactttgtggggtttgcactgttttgtctggagacactgctgagcattggggttcttcagaaagtgtacatgtacttcagagggaacaagtgaagccagtcatgatggagagttacgtttgttgagaaaatttggagttacttgtggctacttgtagcacatgttcattcgatggttttgtgcatacctgtcagtacaccttgaatctataatttcttatgtcagttattggtgccgaaaaaaaaaaaaattgtttttttaaggtggtatgggagtataggtttgcttacggatgggtgctgtggttcttc

SEQ ID NO: 183 - protein, 270 aa, Zea mays
MHHDPNPFDEGSAEDNPFSNGGAGGGKQQYGFRPTEPVGFGGASRGDAVVDVPLETMGDSRSKVKELSSWESDLKRREADIKRREEALKNAGVPMEEKNWPPFFPIIHHDIANEIPANVQKLQYLAFASWLGIVLCLSWNFVAVIVCWIKEGDSKLFFLATIYALLGIPLSYLIWYRPLYRAMRTNSAFSFGWFFLCYLIHIGFCIIAAIAPPIVFHGKSLTGILAAIDTFSEHVIIGIFYFVGFALFCLETLLSIGVLQKVYMYFRGNK

SEQ ID NO: 184 - DNA, 1296 bp, Zea mays
caggacgccattagcagcggttggccaccagcccaccacccgacgccggaggcccggaggaggaggcggcgatggcggggaagcacgggcgcaacggcttcgacgacgacaacgtcaaccctttcgcgggaggaagtgttccacctgccaccaattctcgtctctcacctctatcacatgaaccggctgatttctacaatgtggacattcctctcgactcatcaaaggatctgaagaaaaaggagaaagaactccaggctatggaggctgagctaaacaaaagagaacgggaattgaaaaggaaggaagaggcggcatcccgagctggcgttgtgatagaagagaaaaactggcctccctttttccccctcatccaccacgacatttccaatgaaatacctatccatctacaaaggatgcagtaccttgcattctcatcattcttgggattgatagcgtgtctcttttggaatgtcatagcaactacaacagcatggattaaaggggaaggtgttatgatctggctgcttgccattatctacttcatatctggtgcgcctggggcttatgtgttatggtatcgacctctttataatgcaatgagaactgagagcgctttgaagtttgggtggtttttcctattttacatgattcatataatattctgtgtgtgggcagctgtggctcctccatttcctttcaaaggaaaatctttggctgggattttaccagcaattgatgtcataagcaagaatgctattgtcgggatattttacttcgttggatttggcttgttctgccttgaatcacttctgagcatcggtgtcattcagcaagtctacatgtatttccgtggaagtggaaaagctgcagagatgaaacgtgaggcagcacgtagtgctctaagttcagccttctgatgaacatagggcggtctgattagagcagtagatggataagggaagggaacgagatgtgccaattaagccacgcggtcttgtacatcactgcagtacgtggatttggatcgctgaaagcgtacagctgatcgtctttttgctcttctgtaaaatatgaacaatcatcatatggtccggatgcgtcagggtgttgtttcatttcttgccatggtttagatgtggttgatagggaaaacggtgaagtatttttttggagcagctaatataatgtatcttcatcgtacttttacatgtgagtgtaatagcttatttcttgtggtaggaatacagctttgctgtgttttcgggaatgacatttgttgtgtaaggttattca

SEQ ID NO: 185 - protein, 282 aa, Zea mays
MAGKHGRNGFDDDNVNPFAGGSVPPATNSRLSPLSHEPADFYNVDIPLDSSKDLKKKEKELQAMEAELNKRERELKRKEEAASRAGVVIEEKNWPPFFPLIHHDISNEIPIHLQRMQYLAFSSFLGLIACLFWNVIATTTAWIKGEGVMIWLLAIIYFISGAPGAYVLWYRPLYNAMRTESALKFGWFFLFYMIHIIFCVWAAVAPPFPFKGKSLAGILPAIDVISKNAIVGIFYFVGFGLFCLESLLSIGVIQQVYMYFRGSGKAAEMKREAARSALSSAF

SEQ ID NO: 186 - DNA, 1837 bp, Zea mays
acggacggcgaaaactaaaaggccaaagctgacggacgggacaggtgacaaactccacgcggagtccgctgaaattttggtcgccccatgcccgttctagacgccatggacgatgcggcggcggcggcggtagataggcacggcggcttctagaccgtctccgttttctgcgcgttggccgtcgggggaagtacacaataaacaaagcaagagcagaggtccaactgggctgctgcgtcctctgcctcttctccttcctgtcgttctgcgctgccccgacccccgagtgcccctggtcttgtccaactctccctgctgacctcggagcggagcggagcggagcaagcagccgccaggagggaaggatccatggccgggagatcgcggtacgacaaccccttcgaggagggcggcgccgacgaggtcaaccctttcgcggaccaagctaagagaggaggatcgactgctcagtccggctactctggtggcgcgttctacacgacgcaatcgcaacgccctgctcctcctagcacacgcctttcgcctcttcctcctgaacctgccgacttctacaacgacttcgctaccccagtggatatccccatggacacaaacaaggacatgaagacaagggagaaggagcttctggccaaggaggccgagctgaacaggcgtgagaaggaaataaaaaggcgagaggatgctgcggcacgagctggtatcgtgttggaagagaagaactggcccccgtttttccccatcattcataacgatatcggcaacgagatacctgtccatctgcaaagaacgctgtacgtcgcgttcgcgtcgctcttagggttggtcttgtgcctgttttggaacataatctgcattactgctgcctgggcaaaagggtcaggtcctaagatatggtttctcgcaatcatatacttcatcctcggatgccccggtgcatactacctttggtaccggccactataccgcgcaatgaggaacgagagcgctctcaagttcggatggtttttcctcttctacttgattcatatcgccttctgcgcgtacgcagctgtttctccttcaattctcttcgtgggaaaatcgttaaccgggattttgccagcaatcagcttgataggcgacagcgtcattgttgggatcttctacttcattggctttgcattgttctgcctggaggctttgctaagcgtgtgggtcattcagcgcgtctacctgtacttccgagggagcgggaaagaagcggagatgaggcgtgaagcagcacgcggtgcagcgagggcagcgttttgatgaaaaccgtatatagatgatatatataggcacgacttacatactgttcataatagtttgaagtgctttaggtcaagaggcatgtgtgtacagtagggttggcgtcttgtacatctttaaggccggtttggtgaaacatggaaatggaatgaatccataaaggagagatccgttgttattcaaaattaaataacaaggatctcttctccatgggtcccatccattttcctctccaccaaaccagccctgagttcctatcgccacggtgttttgagccctccagattgatcaatcgtggtacatatgacagtgttagtatatggagtaaatacacatggacgggtaaacctagctagactctttgttccatatgtgcatttttgtgtcaccgccttgtatcaattatttatagacgtaatgaagttgtaatgatgttctcactcgagatttttgagtggggaaattgcaaaagcatacttatgtcaagggagttgtactcatacccacactccaaaaaaaaaaaaaa

SEQ ID NO: 187 - protein, 313 aa, Zea mays
MAGRSRYDNPFEEGGADEVNPFADQAKRGGSTAQSGYSGGAFYTTQSQRPAPPSTRLSPLPPEPADFYNDFATPVDIPMDTNKDMKTREKELLAKEAELNRREKEIKRREDAAARAGIVLEEKNWPPFFPIIHNDIGNEIPVHLQRTLYVAFASLLGLVLCLFWNIICITAAWAKGSGPKIWFLAIIYFILGCPGAYYLWYRPLYRAMRNESALKFGWFFLFYLIHIAFCAYAAVSPSILFVGKSLTGILPAISLIGDSVIVGIFYFIGFALFCLEALLSVWVIQRVYLYFRGSGKEAEMRREAARGAARAAF

SEQ ID NO: 188 - DNA, 1272 bp, Zea mays
gtcacgtacacacgctcacgttggaggctggactccgcccccgtgctgctcttcgccttgcctttctccgccggagaccccgccgcctcagctgccacaggaggaggaggcaaccatggcggggaggtacgaccgcaatccgttcgaggaggatgacgtcaacccctttgcgggaggaagtgtacctcctgcttctaattctcggatgtcagcacttcctcatgaaccagctggcttctacaatgatcgtggtgcaacagtggacatacctcttgattcaacgaaggacctaagtaaaaaggagaaagaactgcaggcaaaggaagctgagctaaacaaacgggaaagggagctgaaaagaaaggaggaagctgcagccagagctggtattgtcattgaagataagaattggccaccctttatgcccattattcatcatgacatttcgaacgagataccaattcacctgcaaaggatgcagtacctggcgttttcttcactattgggattgacagcttgcctcttttggaacatcattgcaactacagcagcatggattaaatcagaaggtgtcatgatctggttgctagcaatcatctacttcatctctggtgtccctggggcctatgtgctttggtatcgcccgctttacaatgcgatgaggactgaaagtgctttgaagtttgggtggtttttcttgttttaccttctccatatcttattctgtgtctggtcagctgtggctcctccatttccattcaaaggaaaatccttggctgggattttgccggctattgatatcataggcaggagtgctattgtggggatattttacttcattggatttggaatgttctgccttgaatcactgctcagcatcgttgtcattcagcaagtatacatgtacttccgtggaagtggaaaagctgcagagatgaagcgagaggcggcccgtggtgctatgaggaatgccttttgatagagcgacctaggcgactggaagagacacggtgtgacaatgggtaactacgttatgtacatatgctgttcgtctttgagattacttatactagcttatagccttcttgccttcatgcaatgtataccacctaccaccggagcttgatctcttacctaggttcagatgtgcttataggtaactagttttttttatacatttcctacatgatttgtactcttaactcgcgagacaattgttgttgttctttggatctcgagtgattctttgcacggcctgaaaccacttggtct

SEQ ID NO: 189 - protein, 287 aa, Zea mays
MAGRYDRNPFEEDDVNPFAGGSVPPASNSRMSALPHEPAGFYNDRGATVDIPLDSTKDLSKKEKELQAKEAELNKRERELKRKEEAAARAGIVIEDKNWPPFMPIIHHDISNEIPIHLQRMQYLAFSSLLGLTACLFWNIIATTAAWIKSEGVMIWLLAIIYFISGVPGAYVLWYRPLYNAMRTESALKFGWFFLFYLLHILFCVWSAVAPPFPFKGKSLAGILPAIDIIGRSAIVGIFYFIGFGMFCLESLLSIVVIQQVYMYFRGSGKAAEMKREAARGAMRNAF

SEQ ID NO: 190 - DNA, 1494 bp, Zea mays
gtttggcccacgagcggttactgggtggacaggtggctccgcgtgtgcgcgttcacccgcctcatcctctccttcgcaagacggcaaagaggagtcgccatcgcccgccccatctagtcggtgtcggtgtggtgtgggggcggtgctgcgcgtgtgcgctcctctgttcggcaggactccttcaagcagaaggggcggagcagcatggcggggcgctacgacggcaaccccttcgaggaggaggacgtgaaccctttctcggaacaagcgcgcggcaaggctggcgggcagtccaacttcggcggtggtgcgttttacatgcctaacaccagaaacatgcctcctgcatccaattcgcgcctttcgccgcttcctcctgaaccagcagacttcagtgctacagtggacatacccctggactcgtcaaaggacctgaagagaagggagaaggagctgcaagcaagggaagcggaattgaacaagagggagaaggaactaaaacggagagaggaggctgcagcgagagctggcattgtcattgaggagaaaaattggcctccttttctgccactcatccatcatgatatcaccaatgagataccgagtcaccttcaaagaatgcaatatgttgcatttgcgtcgtttcttgggttggtttgctgcctcttctggaatgtcatagcagttactacagcttggatcaagggggaaggcgttaagatctggttgttggcaataatctacttcatatctggtgttcctggtgcatatgttttgtggtatcgtcctctatataatgcaatgaggactgatagcgcattgaagtttggattgttcttcttgctttacgtgttccacattcttttctgcgtattttctgctgtggctcctcctgttgtatttgaaggaaaatcattggcaggaattttgccagcaattgatcttattagcgtgaatgctttggttgggatattctactttgttggatttggactgttctgtctggaatcattgctcagcatctgggtcatccagcaagtgtacatgtacttccgtggaagtggaaaggctgcagagatgaagcgtgatgcgacgaggggtgcaatgagagccgcattttaagtgtggtgtggtattttttttgtgatgacagtcctaggcccaagcgcatacttccggtggataggttgtgcaccgaacaaaaagcagatgtttcttccttggttgctgactatgataccaaactgccagtaggttatcatgatgttacaagtgacattatatcactccccgtcctgatctaacaagaatggggaatgtgcagcttttacagctttacttaatcgttttgttcttgctagttgaaatgtggaatggattatgaatcaagtttagttaagttgtacagtgctgttaactatttgtactccttttgaacggctattggtacttcgttggaacaataatacagtggtgatattggcgggaaaaaag

SEQ ID NO: 191 - protein, 305 aa, Zea mays
MAGRYDGNPFEEEDVNPFSEQARGKAGGQSNFGGGAFYMPNTRNMPPASNSRLSPLPPEPADFSATVDIPLDSSKDLKRREKELQAREAELNKREKELKRREEAAARAGIVIEEKNWPPFLPLIHHDITNEIPSHLQRMQYVAFASFLGLVCCLFWNVIAVTTAWIKGEGVKIWLLAIIYFISGVPGAYVLWYRPLYNAMRTDSALKFGLFFLLYVFHILFCVFSAVAPPVVFEGKSLAGILPAIDLISVNALVGIFYFVGFGLFCLESLLSIWVIQQVYMYFRGSGKAAEMKRDATRGAMRAAF

SEQ ID NO: 192 - DNA, 1208 bp, Zea mays
ctcactactccaatctccatcgccattgtcggcgcaagcaaaggggcggagcagcatggcggggcgctatgacggcaaccccttcgaggaggaagacgtgaaccctttctcgcaacaaacgcgcggcaaggctggcgggcaatccaactttggcggtggcgcgttttatatgcctaacccccaaaacgtgcctccgacatccaattcacgcctttcgccgctccctcctgaaccggcagacttcagtgctacagtggatataccccttgactcgtcaaaggacctgaagaaaagagagaaggagctgcaagcaagggaagcggaattaaacaagagggagaaggaactaaaacggagagaggaggctgcagcaagagctggcattgtcattgaggagaaaaattggcctccttttatgccactcatccatcatgatatcatcaatgagataccgagtcaccttcaaagaatgcaatatgttgcatttgcctcgtttcttgggttggtttgctgcctcttctggaatgtcatagcagttactacagcttggatcaagggggaaggtgttaagatctggttattggcaataatttacttcatatctggtgttcctggtgcatatgttttgtggtatcgtcctctgtataatgcaatgaggactgatagtgcattgaagtttggattgttcttcttgctttacttgttccatattcttttctgcgtgtttgctgctgtggctcctcctgctgtatttgagggaaaatcattggcaggaattttgccagcaattgatcttatcagcgtgaatgctttggttgggatattctactttgttggatttggattgttttgtctggaatcgttgctcagcatctgggtcatccagcaagtgtacatgtacttccgtggaagtggaaaggctgcagagatgaagcgtgatgcgacaaggggtgcaatgagagccgcattttaagtggtatttttgtgatgatagtccaaagtcccaatcgcatacttccggtggataggttgtgccaacaaacagaggctggcatatgtttcttccttggttgctgactgtgactaaactgccagtataggttatcgtgatgttacaagtccctgttttaactaaaatacatagggaacgtgcagcttgtacttcatcgttttatttttggtagttgaaatatggacttatgaatcat

SEQ ID NO: 193 - protein, 305 aa, Zea mays
MAGRYDGNPFEEEDVNPFSQQTRGKAGGQSNFGGGAFYMPNPQNVPPTSNSRLSPLPPEPADFSATVDIPLDSSKDLKKREKELQAREAELNKREKELKRREEAAARAGIVIEEKNWPPFMPLIHHDIINEIPSHLQRMQYVAFASFLGLVCCLFWNVIAVTTAWIKGEGVKIWLLAIIYFISGVPGAYVLWYRPLYNAMRTDSALKFGLFFLLYLFHILFCVFAAVAPPAVFEGKSLAGILPAIDLISVNALVGIFYFVGFGLFCLESLLSIWVIQQVYMYFRGSGKAAEMKRDATRGAMRAAF

SEQ ID NO: 194 - protein, 23 aa, Artificial sequence
  transmembrane region 1
AFTTLLGLVGCLLWNIVAVTVAW

SEQ ID NO: 195 - protein, 23 aa, Artificial sequence
  transmembrane region 2
IWLLSIIYFLAGVPGAYVLWYRP

SEQ ID NO: 196 - protein, 23 aa, Artificial sequence
  transmembrane region 3
FGAFFFFYVFHIAFCGFAAVAPP

SEQ ID NO: 197 - protein, 23 aa, Artificial sequence
  transmembrane region 4
TTNAAVGIMYFIGAGFFCIETLL

SEQ ID NO: 198 - protein, 3 aa, Artificial sequence
  tripeptide associated with the biological role of SCAMP proteins
NPF

SEQ ID NO: 199 - protein, 120 aa, Artificial sequence
  N-terminal tail
MARHDPNPFADEEINPFANHTSVPPASNSYLKPLPPEPYDRGATVDIPLDSGNDLRAKEMELQAKENELKRKEQELKRREDAIARTGVVIEEKNWPEFFPLIHHDIPNEIPIHLQKIQYV

SEQ ID NO: 200 - protein, 34 aa, Artificial sequence
  C-terminal tail
NIWVIQQVYAYFRGSGKAAEMKREATKSTLMRAL

SEQ ID NO: 201 - protein, 15 aa, Artificial sequence
  E peptide 1
LWYRPLYRAFRTDSA

SEQ ID NO: 202 - protein, 15 aa, Artificial sequence
  E peptide 2
LWYRPLYNAMRTESA

SEQ ID NO: 203 - DNA, 2194 bp, Oryza sativa; identical to SEQ ID NO: 85

SEQ ID NO: 204 - DNA, 828 bp, Lycopersicon esculentum
atgatttcagcaggtttcggctctgccgtatgcgtgagacctgttgtctccttttcaaacaccataagaagagtacacaaccatggaagagttacatgtttggctacatccatgtcatctgcctcaatgactgttgcaagagatgctgaatacgaattggaaaaccgaaaatatgaactgcttaatatcatccaagatacgcaacgaggcctagtgacaactgctgatcaacgatccaccattgaggaggctatggttgtggttgaaggttttgatgctggcaaggaaattgacttgagtaagttggacggaacatggcggttgcagtatacatctgcaccagacgtgctcattctttttgaatctgctgctaggcttccattctttcaggtgggtcaaattttccagaaatttgagtgccagaatgaatcccgtggaggattggtacgcaatgtcatcaaatggagtgttccacgattattagaggagaatgaaggtgctactctgatagtaactgccagattttcttccgtttctgctcgtaatatttacctcaagtttgaggagataggtcttcaaaatattaacatcagtgacgatctgcaagctgtaatagctccagcaattctgccaaggtcatttttaagtttacagatactgcagtttattcgaagtttcaaagctcgagttccagtgaccagtccagagagacactctgtggggggcctctattacctttcttatctggataagaatatgcttttaggccgcgctgttggaggtggtggagtatttatattcaccagggctcatactcttatttactaa

SEQ ID NO: 205 - protein, 275 aa, Lycopersicon esculentum
MISAGFGSAVCVRPVVSFSNTIRRVHNHGRVTCLATSMSSASMTVARDAEYELENRKYELLNIIQDTQRGLVTTADQRSTIEEAMVVVEGFDAGKEIDLSKLDGTWRLQYTSAPDVLILFESAARLPFFQVGQIFQKFECQNESRGGLVRNVIKWSVPRLLEENEGATLIVTARFSSVSARNIYLKFEEIGLQNINISDDLQAVIAPAILPRSFLSLQILQFIRSFKARVPVTSPERHSVGGLYYLSYLDKNMLLGRAVGGGGVFIFTRAHTLIY

SEQ ID NO: 206 - DNA, 840 bp, Brassica napus
atggatcgaattgcgtctgtaactttctcttgcccggcgttttcaacgcctcgcgtttgtaggatcaaaccttttggtctaaacatcaataccgatcatagaaagagattttcttgtcgagtaaacacgacagcagctaaggtcgtggacagtgaacttgacttagaatacaagaaacacgatctactgagagctgttcaagaaactcaacgaggactcactgctacttctgatcaacgctctcttatagaggaggctctggtgactgtagaagggtttaacggcggtgaagccattgatttgatgaagttagatggaacatggaggctacagtatacatccgcacctgatgttgttgttctctttgaagctgcctcaagatttcctttctttcaggttggtcagatcttccagaagtttgagtgcagagatcgatcagacggtgggatcatcaggaatgttgttcagtggagtgttccaagcttgttagaggaacaagaaggtgcaacacttgttgttactgccaagttcgataaggtctctagtcgaaacatctaccttcagtttgaagagataagtgttagaaacattaatatcaatgagcaagttcaagctcttctcgcacctgcaattcttccacgctccttcttaaaccttcagattttgcagtttatacgtactttcaatgctcagattccagtaaccgcaaccagtccaggaaggagatctgtgggaggattgtattacctctcttatctcgataacaacatgctcttgggccgatctgttggaggtggaggagtctttgtctttacaaaatctcaacccctcgagctctga

SEQ ID NO: 207 - protein, 279 aa, Brassica napus
MDRIASVTFSCPAFSTPRVCRIKPFGLNINTDHRKRFSCRVNTTAAKVVDSELDLEYKKHDLLRAVQETQRGLTATSDQRSLIEEALVTVEGFNGGEAIDLMKLDGTWRLQYTSAPDVVVLFEAASRFPFFQVGQIFQKFECRDRSDGGIIRNVVQWSVPSLLEEQEGATLVVTAKFDKVSSRNIYLQFEEISVRNININEQVQALLAPAILPRSFLNLQILQFIRTFNAQIPVTATSPGRRSVGGLYYLSYLDNNMLLGRSVGGGGVFVFTKSQPLEL

SEQ ID NO: 208 - DNA, 849 bp, Chlamydomonas reinhardtii
atgaaaacctctgtctacggccccagcgttgctcgagccaccggcaccggtcgagcaccactcgtcgcgcgccggtcctcgccaacttacaggccttcagctgccgctgttgcgtcggctccggtttcagatgggccttcaacttcggacaggcaacaggccaaacaggccctgcttgaccttgtaaagaacacaaatcgagggcttggcgttcggacgttcacacgcgggctcatcgaggaggctcagattcgtgtggagtcctttcaaggcagcgcgttggacttcagcatcttgggcgggaaatggaagctcatttacaccaccgccacggacgtgctgcccatccttgaggcggagtaccagctcagcccggggcccttctcggcgctcggcttccctcggccactcgaggttggcaacatctaccagcggttcactagccctgtggacgatgaggggaccgtggagaacatcatcaacttcaaaacccctgcttcgtcgttggtgttcaccgtgggcgccaggtacgacgtgcgctccgggaagcgcatcgcgctggtgtttgaggacgcccggctgggcgatatccagctcagcgacggcgccgaggcattgctggcgccggcactgctgcctcgcggctcgctgcagcaccagctactcctggccatcaaggagttcacgctgaagttccagttccgcaccgcagcgcagctggcgtcgcaggcggtgacgcgcgcgggctcagcggcggcaggctacctgctgacgtacctggacaacgacatgctgatcgggcgcgcgattgggcttgggggcgttttcgtgtttgtgcgggaagaataa

SEQ ID NO: 209 - protein, 282 aa, Chlamydomonas reinhardtii
MKTSVYGPSVARATGTGRAPLVARRSSPTYRPSAAAVASAPVSDGPSTSDRQQAKQALLDLVKNTNRGLGVRTFTRGLIEEAQIRVESFQGSALDFSILGGKWKLIYTTATDVLPILEAEYQLSPGPFSALGFPRPLEVGNIYQRFTSPVDDEGTVENIINFKTPASSLVFTVGARYDVRSGKRIALVFEDARLGDIQLSDGAEALLAPALLPRGSLQHQLLLAIKEFTLKFQFRTAAQLASQAVTRAGSAAAGYLLTYLDNDMLIGRAIGLGGVFVFVREE

SEQ ID NO: 210 - DNA, 837 bp, Centaurea solstitialis
atggcttccttgccgtcggctaccgcaactactcttttccggccaccgtcaacttcatcatcaatgatctcctctcttcctctttcatcttcaaaaagccgaatccgatgctcaacgacgtcgtttacatcaccccaattgaagaaggaatcggaattggagaacaagaaatacgatttgttgaaagctgttcaagatactcaacgtggattagtcactagccctagtcaacggtctgaaatcgaggagtcattggtggatttggagagttttgaagtggatgggaatgaagcaattgatttggggattttggatggaacatggagattgcagtatacatctgcttctgatgttctttcccttcttgatgcttcagctaggtttccattttttcaggtcggccaaatatttcaaaagtttgaatgtaagggtcaagatgatggaggctacatccgcaacgttgttcgttggagtattccaagcttgttagaggagaacgaaggcgccacccttcttgtttcagcaaaattttctctcgtgtctcggcggaatatctaccttcagtttgaagagatagcagttcaaaatataaacatcagcgaagaattgcaagctctaatagctccggcattgctgccacggtcttttttaaccctacaggtcttgcaagcaattcgtacttttaaagctcaagttccggtgagtagcacgagccccggaaggcgatctgtgggagggctttactacctttcgtatctcgataggaatatgcttgtgggtcgagcagtgggaggcggtggtgtattcgtgtttactcgagctcaaaacatattgtaa

SEQ ID NO: 211 - protein, 278 aa, Centaurea solstitialis
MASLPSATATTLFRPPSTSSSMISSLPLSSSKSRIRCSTTSFTSPQLKKESELENKKYDLLKAVQDTQRGLVTSPSQRSEIEESLVDLESFEVDGNEAIDLGILDGTWRLQYTSASDVLSLLDASARFPFFQVGQIFQKFECKGQDDGGYIRNVVRWSIPSLLEENEGATLLVSAKFSLVSRRNIYLQFEEIAVQNINISEELQALIAPALLPRSFLTLQVLQAIRTFKAQVPVSSTSPGRRSVGGLYYLSYLDRNMLVGRAVGGGGVFVFTRAQNIL

SEQ ID NO: 212 - DNA, 612 bp, Chlorella vulgaris
atggacatttctttgcagaacgacatgtatgtgatcggcccagacgtgggcctggaggccctttcaaacagggcaattgattacaccttgctgcctggcaggtggagactgatatacacaacagccccagatgtcaggccactcttgattgcggatcgccctgcaccctttcaagtcggcaacatctatcagcaattttcagatgtggagcagggcgacgtccagaacatcatcgagttcagcattcccatgctactccagaaaggaaccgtggaggtgcgagcaaagtatgacatcaggagccctcagcgcatacgcctgatgttccaggaagctggagtgaggaacttgagtatcacagatgagctggagttgctcttggcccctgcaatactgccgcggtcttggttgaatcatcaggtcctcctggcattgagggaggcggaggtctttgtgccgctgcgcgccagactgccagccctattccagagcgcctccaccagtctggagaggaattttgggtcggattacctgttgacgtacttggacgatgacacgctgattggctcccagacaggcagtggagggactttcatctttgtgcgagactga

SEQ ID NO: 213 - protein, 203 aa, Chlorella vulgaris
MDISLQNDMYVIGPDVGLEALSNRAIDYTLLPGRWRLIYTTAPDVRPLLIADRPAPFQVGNIYQQFSDVEQGDVQNIIEFSIPMLLQKGTVEVRAKYDIRSPQRIRLMFQEAGVRNLSITDELELLLAPAILPRSWLNHQVLLALREAEVFVPLRARLPALFQSASTSLERNFGSDYLLTYLDDDTLIGSQTGSGGTFIFVRD

SEQ ID NO: 214 - DNA, 615 bp, Chlorella
atgcagcaccaggtggcggtggaggggtacgggagcggcgccgagctggactttggtctgctggagggcaagtggcggctggagtacaccacagcgcgcgacgtgctgccgctggtggcgcctcagcgcctgcccgcgccgctgcaggtcggccgcatctggcagcagttctcctcgctggaggaggggcgggtgcagaacatcatcgaggcgcacctgccgccgctgccgctgctgggcgccgcggggctgggcctgtcgctggtggtggaggcggggtatgaggcccgcaccgcgcgcagcatagccctcaccttcaggcaggctggctttcgcgacgtggagctcagccctgagctgcagaacctgctggcctccccgctgctgccgcgcggctggtggaaccagcagctgctgctggcgctcaaacagctgtcgggcagcgtgccgctgacctctcgcctgccgggcaccaccagcgaccagcagcggccggtgggcctcaactacatgctcacatacctagacgaggacatgctgatcgggcgggcacagggcaacggcggcgtctttgtcttcacgcgggatgcggaagcgcaggaggcagcgcactag

SEQ ID NO: 215 - protein, 204 aa, Chlorella
MQHQVAVEGYGSGAELDFGLLEGKWRLEYTTARDVLPLVAPQRLPAPLQVGRIWQQFSSLEEGRVQNIIEAHLPPLPLLGAAGLGLSLVVEAGYEARTARSIALTFRQAGFRDVELSPELQNLLASPLLPRGWWNQQLLLALKQLSGSVPLTSRLPGTTSDQQRPVGLNYMLTYLDEDMLIGRAQGNGGVFVFTRDAEAQEAAH

SEQ ID NO: 216 - DNA, 849 bp, Gossypium hirsutum
atggaattagcatttgccgcttcagtatacccaacaaatgtgaagagagtaatctacgagataagacctcacagctcaaaactcgttaccaacaagagacggtcttttcacaagaagtttctatgctcagtagctgttgctcctgacaggaatcgggtatccgaggttgagttggaaaacaagaaacacaatcttctcctggctgttcaagacacacaacggggacttgctgcaactgctgatcaacgctcaattatcgaggaggctctggtgagtgtagagggatacaacatgggtgcaccacttgacatggcggtgttggatggaacttggcgcctgcagtacacttctgccccggatgttgtcgttcttttggaagctgctgcaaggcttcctttctttcaggttgggcagatcttccagaaatttgaatgcagggatcagctcagaggaggtgttatccgaaatgttgttcgatggagtattccgaatttgttagaggaacaagaaggtgccactctggttgtttctgctaagttcgatgttgtttctgtgcggaacatctatcttcagtttgaagagataaaagttcaagatataaacatcagtgaacaactgcaagctctgattgctccagcactccttccacggtcatttttaagtctacagattttgcagtttctccgaaccttcagagctcaagttcctgtaagaaaccctgggactggaaggagatcagtaggaggactttattacctttcgtatctggatcagaatatgctgttgggcagagctttcggcggtggcggagtatttgtgtttacgaaggctcaacctcttgagctttaa

SEQ ID NO: 217 - protein, 282 aa, Gossypium hirsutum
MELAFAASVYPTNVKRVIYEIRPHSSKLVTNKRRSFHKKFLCSVAVAPDRNRVSEVELENKKHNLLLAVQDTQRGLAATADQRSIIEEALVSVEGYNMGAPLDMAVLDGTWRLQYTSAPDVVVLLEAAARLPFFQVGQIFQKFECRDQLRGGVIRNVVRWSIPNLLEEQEGATLVVSAKFDVVSVRNIYLQFEEIKVQDINISEQLQALIAPALLPRSFLSLQILQFLRTFRAQVPVRNPGTGRRSVGGLYYLSYLDQNMLLGRAFGGGGVFVFTKAQPLEL

SEQ ID NO: 218 - DNA, 831 bp, Glycine max
atggacatggttctgcattcagccttgtacccaccatctctgtcttgttcctcttctactactggaacaagatggcccaattcccgggttggtgttagtttgagttggaggagcttgtccttggtgccttgtgcactgaaggcatattatgattctgaattggagaataaaaagcatctacttctgacctctgtccaagacacgcaaaggggcctcttaacaactcctgatcaacgctcttgtatcgaggaggctctggtgagtctcgaaggatgcaacattggctctcaccctatcaatctctccaacttggatggaacatggcgcctccagtacacttctgcctctgatgttctcattcttctccaagctgctgctactcttcctttctttcaagttggacagatctttcaaaaatttgaatgtcgtgatcaatctaatggaggtgttatccgcaatgttgttcgatggagcattccaaatttgttagaggaacaagaaggtgctacactgcttgtatccgccaagtttaatgtagtatctgtccgtaatatctaccttcagtttcaagagatcacaatccaagatataaatattagtgaagagctgcaggctctaatagctccagcaatactaccaagatcttttataagtcttcagattttgcaatttctccgcactttcaaagctcaaatccctgtgagggatccaggaaggcaatcagttggaggactatattaccttagctatttggatgataatatgcttttgggtcgtgctgttggtggaggaggggtatttgtgtttacgagagcccaatctctctactga

SEQ ID NO: 219 - protein, 276 aa, Glycine max
MDMVLHSALYPPSLSCSSSTTGTRWPNSRVGVSLSWRSLSLVPCALKAYYDSELENKKHLLLTSVQDTQRGLLTTPDQRSCIEEALVSLEGCNIGSHPINLSNLDGTWRLQYTSASDVLILLQAAATLPFFQVGQIFQKFECRDQSNGGVIRNVVRWSIPNLLEEQEGATLLVSAKFNVVSVRNIYLQFQEITIQDINISEELQALIAPAILPRSFISLQILQFLRTFKAQIPVRDPGRQSVGGLYYLSYLDDNMLLGRAVGGGGVFVFTRAQSLY

SEQ ID NO: 220 - DNA, 831 bp, Glycine max
atggacatggttctgcattcagccttgtacccaccatctctgtcttgttcctcttctactactggaacaagatggcccaattcccgggttggtgttagtttgagttggaggagcttgtccttggtgccttgtgcactgaaggcatattatgattctgaattggagaataaaaagcatctacttctgacctctgtccaagacacgcaaaggggcctcttaacaactcctgatcaacgctcttgtatcgaggaggctctggtgagtctcgaaggatgcaacattggctctcaccctatcaatctctccaacttggatggaacatggcgcctccagtacacttctgcctctgatgttctcattcttctccaagctgctgctactcttcctttctttcaagttggacagatctttcaaaaatttgaatgtggtgatcaatcccatggaggtgttatccgcaatgttgttcgatggagtattccaaatttgttagaggaacaagaaggtgctacactgcttgtatccgccaagtttaatgtagtatctgtccgtaatatctaccttcagtttcaagagatcacaatccaagatataaatattagtgaagagctgcgggctctaatagctccagcaatactaccaagatcttttataagtcttcagattttgcaatttctccgcactttcaaagctcaaatccctgtgagggatccaggaaggcaatcagttggaggactatattaccttagctatttggatgataatatgcttttgggtcgtgctgttggtggaggaggggtatttgtgtttacgagagcccaatctctctactga

SEQ ID NO: 221 - protein, 276 aa, Glycine max
MDMVLHSALYPPSLSCSSSTTGTRWPNSRVGVSLSWRSLSLVPCALKAYYDSELENKKHLLLTSVQDTQRGLLTTPDQRSCIEEALVSLEGCNIGSHPINLSNLDGTWRLQYTSASDVLILLQAAATLPFFQVGQIFQKFECGDQSHGGVIRNVVRWSIPNLLEEQEGATLLVSAKFNVVSVRNIYLQFQEITIQDINISEELRALIAPAILPRSFISLQILQFLRTFKAQIPVRDPGRQSVGGLYYLSYLDDNMLLGRAVGGGGVFVFTRAQSLY

SEQ ID NO: 222 - DNA, 849 bp, Gossypium raimondii
atggaattagcatttgccgcttcagtatacccaacaaatgtgaagagagtaatctacgagataagacctcacagctcaaaactcgttaccaacaagagacggtcttttcacaagaagtttctatgctcagtagctgttgctcctgacaggaatcgggtatccgaggttgagttggaaaacaagaaacacaatcttctcctggctgttcaagacacacaacggggacttgctgcaactgctgatcaacgctcaattatcgaggaggctctggtgagtgtagagggatacaacatgggtgcaccacttgacatggcggtgttggatggaacttggcccctgcagtacacttctgccccggatgttgtcgttcttttggaagctgctgcaaggcttcctttctttcaggttgggcagatcttccagaaatttgaatgcagggatcagctcagaggaggtgttatccgaaatgttgttcgatggagtattccgaatttgttagaggaacaagaaggtgccactctggttgtttctgctaagttcgatgttgtttctgtgcggaacatctatcttcagtttgaagagataaaagttcaagatataaacatcagtgaacaactgcaagctctgattgctccagcactccttccacggtcatttttaagtctacagattttgcagtttctccgaaccttcagagctcaagttcctgtaagaaaccctgggactggaaggagatcagtaggaggactttattccctttcgtttctggatcagaatatgcttttgggcagagctttcggcgggggcggagtatttgtgtttacgaaggctcaccctcttgagctttaa

SEQ ID NO: 223 - protein, 282 aa, Gossypium raimondii
MELAFAASVYPTNVKRVIYEIRPHSSKLVTNKRRSFHKKFLCSVAVAPDRNRVSEVELENKKHNLLLAVQDTQRGLAATADQRSIIEEALVSVEGYNMGAPLDMAVLDGTWPLQYTSAPDVVVLLEAAARLPFFQVGQIFQKFECRDQLRGGVIRNVVRWSIPNLLEEQEGATLVVSAKFDVVSVRNIYLQFEEIKVQDINISEQLQALIAPALLPRSFLSLQILQFLRTFRAQVPVRNPGTGRRSVGGLYSLSFLDQNMLLGRAFGGGGVFVFTKAHPLEL

SEQ ID NO: 224 - DNA, 855 bp, Arabidopsis thaliana
atggatcgaattgcgtctgcgactttctcttgccctgcgatttcattgtcccgcgtctgtagaatcagcccttttggcttaaacattaaaaccaaccatagaaagagattctcgtgtcgagtagctgtagcttctggagagacttcggccagggtcgtcgtcgacaatgaacttgacttagaacacaagaaacacgatctactgagagctgttcaagacactcaacgaggactcactgccacttctgatcaacgatctatcattgaggaggctctggtgactgtggaagggtttaatggcggtgaagaaattgatccagtgaagttagatggaacatggaggctacaatatacatctgcacctgatgttgttgttctgtttgaagctgcttcaagacttcccttctttcaggtagggcaggtctttcagaagtttgagtgcagagatagatccgacggtgggatcattcggaatgttgttcagtggagtcttccaagcttgttggaggagcaagaaggtgcaacacttgttgttaccgcgaaatttgataaggtctctagtcgaaacatctaccttcagtttgaagagataagtgttagaaacattaacatcaatgagcagcttcaagctcttatcgcacctgcaatacttccacgctcatttctaagcctacagcttttgcagtttatccgtactttcaaagctcagattccagtaaacgcaaccagcccaggaaggagatctgtaggtggattgtattacctatcgtatctcgataacaacatgcttttgggacggtctgtaggaggaggaggagtatttgtctttacaaaatctcaacccctcgagctgtga

SEQ ID NO: 225 - protein, 284 aa, Arabidopsis thaliana
MDRIASATFSCPAISLSRVCRISPFGLNIKTNHRKRFSCRVAVASGETSARVVVDNELDLEHKKHDLLRAVQDTQRGLTATSDQRSIIEEALVTVEGFNGGEEIDPVKLDGTWRLQYTSAPDVVVLFEAASRLPFFQVGQVFQKFECRDRSDGGIIRNVVQWSLPSLLEEQEGATLVVTAKFDKVSSRNIYLQFEEISVRNININEQLQALIAPAILPRSFLSLQLLQFIRTFKAQIPVNATSPGRRSVGGLYYLSYLDNNMLLGRSVGGGGVFVFTKSQPLEL

SEQ ID NO: 226 - DNA, 849 bp, Lactuca virosa
atggatttgcggttgccgactacaactgctcttttccggccaccaacaacttcatatattttaccttcttcatcaaccttctcctttcccttctcatattcaagaaatggatttcgatgctccatgacaacaacctttacatcatccccaccacagataaatgaaacagaattagaaaacaagaaatatgacttgttgaaagctgttcaagacactcagcgtggacttaccactacccctaaccaacgctcggaaattgaagagtctttggtggatttggagagttgtcgagtggataatgaaccaattgatttggagaaattggatggaacatggcgattgcagtatacatctgcctctgatgttcttgttcttcttgattcttcctctagacttcccttttttcaggttggccagatatttcagaagtttgaatgcaagggtaaagataatggaggctacatccgcaatgttgttcgttggagtattcctagattgttggaggacaacgaaggtgctaccctccttgtatctgcaaaattttctatcgtgtcccggcgtaacatctacctgcagtttgaagagatatctcttcaaaatataaatataagtgacgaattgcaagctctaatagccccggcattactgccacgctcattcttgaccttacagatattgcaagcaattcgttcttttaaagctcaagttccagtgagtaccacaagcccaggaaggcaatcggtgggaggactttactacctttcgtatctggacaggaatatgcttgtgggtcgagcggtgggaggtggtggtgtatttgtatttactcgagctcaaaacttcgtgtaa

SEQ ID NO: 227 - protein, 282 aa, Lactuca virosa
MDLRLPTTTALFRPPTTSYILPSSSTFSFPFSYSRNGFRCSMTTTFTSSPPQINETELENKKYDLLKAVQDTQRGLTTTPNQRSEIEESLVDLESCRVDNEPIDLEKLDGTWRLQYTSASDVLVLLDSSSRLPFFQVGQIFQKFECKGKDNGGYIRNVVRWSIPRLLEDNEGATLLVSAKFSIVSRRNIYLQFEEISLQNINISDELQALIAPALLPRSFLTLQILQAIRSFKAQVPVSTTSPGRQSVGGLYYLSYLDRNMLVGRAVGGGGVFVFTRAQNFV

SEQ ID NO: 228 - DNA, 843 bp, Malus domestica
atggaactagcactttgttctccattgttcccttcaaatgcaacaagaggtgtcaataagattaagccttatagctccatgctcattgcctcacaaaagttgtccgcccagaaatcgtttccatgtctcgcagctgttgctacccaagcagcccagacggtggagcttgaggtagagagcaagaaacatgagctgttgagagctatacaagacaccgaaaggggccttgttacaaccgatgatcaacgctcatttatagaggaggctctggtgagtgtggagggctataacatgggtgcaccaatagacttggtgaaattggatgggacgtggcgtttgcaatatacttccgcttctgacgttctcattcttctggaagcggctgaaaggctaccattttttcaggttgggcaaatttttcagaaatttgaatgcaaagaccagaccaacgggggagtgatccgtaatgttgtcagatggagcattccacctttgttagaggaacaagaaggtgcgactctgctagtttctgcaaaattttcggttgtttctgtgcgtaacatctaccttcagttcaaagagattaatgttcaagatattaaaatcagtgaagagctgcaggctctaatagctccagcaatattgccacgatcgtttttaagtttacagatcttgcagtacctccggactttcaaagcgcaaattcccgttagagatccaggaagtaggcaatcggtcggaggactatattacctttcttacttggacgctaatatgcttttggggcgcgcggttggtggcggaggagtttttgttttcacgaaagctcaacctctgaagtaa

SEQ ID NO: 229 - protein, 280 aa, Malus domestica
MELALCSPLFPSNATRGVNKIKPYSSMLIASQKLSAQKSFPCLAAVATQAAQTVELEVESKKHELLRAIQDTERGLVTTDDQRSFIEEALVSVEGYNMGAPIDLVKLDGTWRLQYTSASDVLILLEAAERLPFFQVGQIFQKFECKDQTNGGVIRNVVRWSIPPLLEEQEGATLLVSAKFSVVSVRNIYLQFKEINVQDIKISEELQALIAPAILPRSFLSLQILQYLRTFKAQIPVRDPGSRQSVGGLYYLSYLDANMLLGRAVGGGGVFVFTKAQPLK

SEQ ID NO: 230 - DNA, 825 bp, Nicotiana tabacum
atgatttcaggtttcagttctgccatatgcacgagacctaatgtttccttttcaaacaccataagaggagtgcacaaccatggaagagttgcatgtttggccacctccatgtcatctatctccatgactgcggcaagagattctgagaatgaactggaaagccaaaaatacgaattgcttaaaatcatccaagatactcaacgaggcctggtgacaactgctgatcaacgatccatcattgaggaggctatggtagtggttgaaagttttgatgctggcaaagaaattgacttgagtaagttggacggaacatggcggttgcagtatacatctgcatcggacgtggtcattctttttgaatctgctgctaggcttccgttctttcaggtgggtcaaatattccagaaatttgagtgcaagagtgaatcccgtggaggactagtacgcaatgtcatcaaatggagtgttccacgcttattagaggagaatgaaggcgctactctgatagtttctgccagattttcttgcgtttcagctcgtaacatttacctcaagtttgaggagataggtcttcaaaatattaacatcagtgaagatctgcaagcggtaatagctccagcaattctgccaaggtcatttttaagtttacagatactgcagtttattcggagtttcaaagctcaagttccagttaccagcccagagaggcgatctgtagggggcctatattacctttcttatcttgataacaatatgctcttaggccgcgctgttgggggtggtggagtatttgtattcactagagcacaagctcttaccttctag

SEQ ID NO: 231 - protein, 274 aa, Nicotiana tabacum
MISGFSSAICTRPNVSFSNTIRGVHNHGRVACLATSMSSISMTAARDSENELESQKYELLKIIQDTQRGLVTTADQRSIIEEAMVVVESFDAGKEIDLSKLDGTWRLQYTSASDVVILFESAARLPFFQVGQIFQKFECKSESRGGLVRNVIKWSVPRLLEENEGATLIVSARFSCVSARNIYLKFEEIGLQNINISEDLQAVIAPAILPRSFLSLQILQFIRSFKAQVPVTSPERRSVGGLYYLSYLDNNMLLGRAVGGGGVFVFTRAQALTF

SEQ ID NO: 232 - DNA, 858 bp, Oryza sativa
atggcgctcgccgctgctcccctgctccgcctcccgatctccccaccctccccaccgccggcgcagacgccgccgcctctcctggcgtgtaactccgtcaacggcgtccgccttcgccctcagcgcagcaggcaaccgcgccgcgccgccgcggcggcggcaacggcttcgctggcggcggacacggagcggcggaagcacgagctgctgcgggcggtgcaggagacggggaggggattcgcggcgagccccgaccagcgcgcgtccatcgaggaggccatcgtgagcgtggaggagctcggcgccggggaggggtcgccgctggacctcgcggcgctcgacggcacgtggaggctgtgctacacctcggcgtcggacgtgcgcgtgctgttcgaggccgccgagaggctccccctcctgcaggtggggcaaatataccagaaattcgaatgcaaggataggtcagatggtggggttgtgcggaatgttgtgcgatggagcattgagaacttgctggaggagcaagagggtgcaacactgatggtctctgcaaaatttgctgtcatgtctaagcgcaacatcttccttcaatttgaggaggttgttgtagaaaatatcaagattagtgagcagctacaagcactaatagctcctgctatactccctcggtcattttttagtcttcagatattgcagttccttaaaacttttcgagctcaagttcctgttaatggccctgaaaggagatcacccggaggactatattatctttcttaccttgaccgcgatatgctcctggggcgatcggttggtggtggaggagtttttattttcacaagagcacagcctcttttgtga

SEQ ID NO: 233 - protein, 285 aa, Oryza sativa
MALAAAPLLRLPISPPSPPPAQTPPPLLACNSVNGVRLRPQRSRQPRRAAAAAATASLAADTERRKHELLRAVQETGRGFAASPDQRASIEEAIVSVEELGAGEGSPLDLAALDGTWRLCYTSASDVRVLFEAAERLPLLQVGQIYQKFECKDRSDGGVVRNVVRWSIENLLEEQEGATLMVSAKFAVMSKRNIFLQFEEVVVENIKISEQLQALIAPAILPRSFFSLQILQFLKTFRAQVPVNGPERRSPGGLYYLSYLDRDMLLGRSVGGGGVFIFTRAQPLL

SEQ ID NO: 234 - DNA, 918 bp, Ostreococcus taurii
atggcggcgtcgcgcgcggcgacgacggcgacgggcgcggcgacgcgaggcgcgagatgtgcgtcgaacgcgccggattcctcgagatgtcgtcgtcaatccttggtttcttcgcgtcgagcgtgcgagcgtcgtcggaggtcttcgacggcggctgtgcacgacggtgttgacgtcgcgtcgtcgagcgcgacggaggccgacgtgggcgacgcgcgacgaagggccaaggcgagactcgtggacgcgtgcgtcgggacgtatcgcggcgcgctgacgacggcggacgatcgatcggcgatcgcggaggcgcaaggcgcgctggaaaggatcggggacggctcagaaacgattgatttcgatgccttggacgggaaatggcggttggcgtacacgaacgcgtcggacgtgcttgggttgttgattgcgagtcgaacgacgggcgtgcctgaggtcggggacatctttcaatcattttcgtgtaaaaatggcaagaatgaggggatcacgaacgagatcagactctccttaccgttcatcctgagcgaagccaagcgaggcgagcccgggggcgttgggctgcgcgtgcaggcgagttatgaggacatcgggcggcgacgactgcgtttgacgtttcaagaggccaaggtgagcgagatcaacatctcaccactcgccgagacgctcttggcacccgccatcttaccgcgagggagcttgaaccaccaagtgctgatgtttataaaggagttggagctcaagttcccgctcagaggggcgctgacgtccattggcggtggcgagccgtccggtggcgccgctgtcgggtcgtatcacctcacgtacgtggacgaagacgttcttgtcgggcgcgcccaggccggcggagtgtacatttttacgcgcgctgaattatag

SEQ ID NO: 235 - protein, 305 aa, Ostreococcus taurii
MAASRAATTATGAATRGARCASNAPDSSRCRRQSLVSSRRACERRRRSSTAAVHDGVDVASSSATEADVGDARRRAKARLVDACVGTYRGALTTADDRSAIAEAQGALERIGDGSETIDFDALDGKWRLAYTNASDVLGLLIASRTTGVPEVGDIFQSFSCKNGKNEGITNEIRLSLPFILSEAKRGEPGGVGLRVQASYEDIGRRRLRLTFQEAKVSEINISPLAETLLAPAILPRGSLNHQVLMFIKELELKFPLRGALTSIGGGEPSGGAAVGSYHLTYVDEDVLVGRAQAGGVYIFTRAEL

SEQ ID NO: 236 - DNA, 1038 bp, Physcomitrella patens
atgtcgacagttctgcgaggaggaggaggaggaccctggctgctgcaccctcttccctgcagtgttgctcactctctggaaaaggcgaagaagaagaagcagaaacagaagtgcagccagggagctgggctgcgggttgaagcggctccgcggtgtctaagccgcaaattagcgcattgtcttcgagattgtggtgggttcccgttggtgagaatccagaatgggtgggattctgtgcagccggcgcgttcaaggacttttgacgctctgggagcaattgcggagggacgagagcaagttcagatggatcacgacagagagcaggaggtggagagggccaaaatggatcttcttcgggcggtgatagagaccaaaaggggtgtgcaggttactgcagagcaacgtgcagatatagaagaggcactggtgggcgtggagacgttcaatgcaggatcacctttactgctagaccagctgcacgggacgtggttattacagtatacgaccgctcctgatgttatctcaatcttacaagctgctgaacagctccctttgctgcaggttggacaagtgtatcagaatttcgactgcagacgaagaacggacggtggagtagttgaaaatattgtgcgatggagtgtgccaggacttctacaggagaatgagggtgcaactctaatagtgacagcgaaattctctgtggctagtgcacgcagtatagttcttcaatttgaagaggcgagggtaagtgaggttgagataagtgaagttttggaatcgttcattgctccggcacttctacctcgcacatttatcaacttacagattttgcagtttttacgcggtctagatctacgatttcctcttgcccgaggatcgcaagggctacagactctgcctgaaaattccagaagggctcctattggattatggtacaacctgacatttttggacaacaacatgcttgtggggcgggctcttggcaatgggggtatctttatcttcagccggactcaagcccgtcctaaatccgtgtga

SEQ ID NO: 237 - protein, 345 aa, Physcomitrella patens
MSTVLRGGGGGPWLLHPLPCSVAHSLEKAKKKKQKQKCSQGAGLRVEAAPRCLSRKLAHCLRDCGGFPLVRIQNGWDSVQPARSRTFDALGAIAEGREQVQMDHDREQEVERAKMDLLRAVIETKRGVQVTAEQRADIEEALVGVETFNAGSPLLLDQLHGTWLLQYTTAPDVISILQAAEQLPLLQVGQVYQNFDCRRRTDGGVVENIVRWSVPGLLQENEGATLIVTAKFSVASARSIVLQFEEARVSEVEISEVLESFIAPALLPRTFINLQILQFLRGLDLRFPLARGSQGLQTLPENSRRAPIGLWYNLTFLDNNMLVGRALGNGGIFIFSRTQARPKSV

SEQ ID NO: 238 - DNA, 951 bp, Picea sitchensis
atgtgtaaaacaacattaacgatggatatggttgtgtttggttgtcgttcacttccagccaattttcatgaaagaacactgcagcggaccagaatgggagcaccattgcaccacaacaaaccccaaatgcaaccaactgctttgcaattacccatgatttctacacctttatcatttgggatttcaacgaaagaccgcaggaggccaactagattcacttaccgagcatacacagagtcttctgaatcacaggtcgcgagagaattgcagaagagcaagttagagctgctcagagctgcccaaaatactcagcgtggatttcaggcttctcatgatcagcgcgctactattgaagaagctatggtgagcgtggagcaatatgatgcttgtataccaatcaatctgaaccagctagacggaacatggcttctgcaatacacatcagcatcagatgtccttgttttatttcaagctgccagccttccctttttccaggttggtcaaatttatcaaaagtttgaatgtaaaggatgtgatgacggaggaattgttcgcaacatagttcgttggagcgtcccaagtattttacaggaaaatgaaggtgcaacattattagtcactgcaaaattttcactgttatctcagcgcaatatatatttgcagtttgaagaggtttctgttgggaacttgatgatcagtgaacaattacagacattaatagctccagcatttttgccacgaacatctttgagtctggagattttgcaacttttacgcagttttgaaacaaagatcccactgcttgggaatagtgatgagcaagctgacaggaggccttcacctggtggactgtattacctttcgtatttggatcgtgatatgcttttggggcgtgcacttggtggtggtggagttttcattttcagtcggacacaaccctttcaagtttaa

SEQ ID NO: 239 - protein, 316 aa, Picea sitchensis
MCKTTLTMDMVVFGCRSLPANFHERTLQRTRMGAPLHHNKPQMQPTALQLPMISTPLSFGISTKDRRRPTRFTYRAYTESSESQVARELQKSKLELLRAAQNTQRGFQASHDQRATIEEAMVSVEQYDACIPINLNQLDGTWLLQYTSASDVLVLFQAASLPFFQVGQIYQKFECKGCDDGGIVRNIVRWSVPSILQENEGATLLVTAKFSLLSQRNIYLQFEEVSVGNLMISEQLQTLIAPAFLPRTSLSLEILQLLRSFETKIPLLGNSDEQADRRPSPGGLYYLSYLDRDMLLGRALGGGGVFIFSRTQPFQV

SEQ ID NO: 240 - DNA, 1029 bp, Populus trichocarpa
atggcttttgctacttcgttgtatcctgcaactggaaagagacccattttcaaaattattaacccttttacttgtaacgctgccactagaagaaatctcaccgttcgaagaaacttttcatgttcagcaactgtagctactgatatcactgctcgggtatctgaatttgagattgagaacaaaaaaaatgatttgttgagattggtccaagacacgcaacgagggcttgttaccactcctgatcaacgctcttctattgaggaggctctagtgagcttggaaggatacaacatgggtgagtcagttgacctggtgcggctggatggcacatggcgcctacagaacacctctgcccctgatgttcttgttctctttgaatctgctgcaagcctttctacttgtggcattttatcttttgatttggctttcatgtatctagttgccacaatttatgtagtttggctatttgtacatgaatcctatttcttaaacatcaatcttcgactccttgatgggttagttttttttcctgctttctctcttcagcttttgttgtactttttatttgggttaccaagtaatgttgggcagatctaccagaaatttgaatgtagagatcagtctgatggtggtgtcattcgcaatgttgttcaatggagtatcccaacattgttagaggaacaagaaggtgctactctccttgtttccgcaaaatttaatgttgtttctgcacgcaacatctatcttcagtttgaagagataagcattcaaaacattagaatcagtgaagagttgcaagctttaatagctccggcactgctacctcgttcatttcttagtctacagatcctacagtttatccgtactttcaaagctcatgttcctgtaagaaacccaggagacccggggaggcgatcagtgggaggtctatattacctctcctatctggatcgcaatatgcttttggggcgtgctgtaggaggtggtggagtttttgtctttaccagagctcagcctattgacttgtga

SEQ ID NO: 241 - protein, 303 aa, Populus trichocarpa
MAFATSLYPATGKRPIFKIINPFTCNAATRRNLTVRRNFSCSATVATDITARVSEFEIENKKNDLLRLVQDTQRGLVTTPDQRSSIEEALVSLEGYNMGESVDLVRLDGTWRLQNTSAPDVLVLFESAASLSTCGILSFDLAFMYLVATIYVPSNVGQIYQKFECRDQSDGGVIRNVVQWSIPTLLEEQEGATLLVSAKFNVVSARNIYLQFEEISIQNIRISEELQALIAPALLPRSFLSLQILQFIRTFKAHVPVRNPGDPGRRSVGGLYYLSYLDRNMLLGRAVGGGGVFVFTRAQPIDL

SEQ ID NO: 242 - DNA, 858 bp, Sorghum bicolor
atggcgctcgccgccccttcttccctccgccgcctcccgaccacgccaccgcatgtgctgtctccgccctgtgcctaccgcctccgctcgcgccctctgcgggagccccgtctctgccggagactcgtcgccgcggcggcggccgccacggctccactcgcttcgtcgcccaccaccgcggacacggagcggaggaagcacgagctgctgcgcgcggttcaggaaacgcggcgcggattcgcggcggggcccgaccaacgcgctgccatcgaggaggccgtcgtggccgtggaggagcgtggtgcggggaaggggacgccgctagatctcgcggcgctcgatggcacctggaggctgtgttacacatcggcgtcagacgtgcttgtgctgttcgaggcggccgagaggcttccacccctgcaggtggggcaaatatatcagaaatttgagtgcaaagatcgatcagatggtggaactgtgcggaatgttgtaaggtggagcatcgagaacttgctggaggagcaagaaggtgcaacactgatggtctctgcgaagtttgttgtcctgtctaaacgcaatatctttcttcaatttgaggaggtcgctgttgaaaatatcaagattagtgagcaactgcaggcattaatagctcctgctatacttcctcggtcatttttgagccttcagatattgcagttccttaaaacctttcgagctcaagttcctgttggtggtcctgaaagacgatcacctggaggactatattatctttcttaccttgatcgtgatatgctcctgggtcgttcagttggtggtgggggagtatttgttttcacaaaagcacaacctcttacgtaa

SEQ ID NO: 243 - protein, 285 aa, Sorghum bicolor
MALAAPSSLRRLPTTPPHVLSPPCAYRLRSRPLREPRLCRRLVAAAAAATAPLASSPTTADTERRKHELLRAVQETRRGFAAGPDQRAAIEEAVVAVEERGAGKGTPLDLAALDGTWRLCYTSASDVLVLFEAAERLPPLQVGQIYQKFECKDRSDGGTVRNVVRWSIENLLEEQEGATLMVSAKFVVLSKRNIFLQFEEVAVENIKISEQLQALIAPAILPRSFLSLQILQFLKTFRAQVPVGGPERRSPGGLYYLSYLDRDMLLGRSVGGGGVFVFTKAQPLT

SEQ ID NO: 244 - DNA, 744 bp, Selaginella moellendorffii
atggcgcggctctcctcctgctcgagagcctcggcggctctccaatctcatcaggagagaacgagagatctccacaaggcgaagatgagcttgctcaaggccgtgattgacacgagcaggggatctcgagcgagccaagaccagcgcgcgcttctcgaggagtcaatggtggaagtcgaaagttttgatgcggggactgccctggatcttgacaagctggatggaacttggctgctgcaatacacttctgcttcagatgttctttccatcttgcaagctggagagtttccatttttcaaggctggacagatttatcaaaagtttgagtgcaagggacgcttcgatggcggacaagtcgtgaacgttgtaaggtggagcatccctggcttattgcaggatggagaaggggcgacgttgtttgttacggctggcttctcggttgtgagtgctcggacgatacaattggagtttaaagaggctagactcggggaggttctgataagtgaagagctccaagccttgctcgctccagccgttctgccacgaacgtttctaaatctccagatcctccaagctataaactctctggacgttagagttccattgcgcggaagaagaccctccaacgaaagaaggtctcttggacttctctactatctcacgtacctggacaacgacatgcttctcggccgggcaatcggcagtggaggagtgttcgtgtttggaaagacccagtccttctga

SEQ ID NO: 245 - protein, 247 aa, Selaginella moellendorffii
MARLSSCSRASAALQSHQERTRDLHKAKMSLLKAVIDTSRGSRASQDQRALLEESMVEVESFDAGTALDLDKLDGTWLLQYTSASDVLSILQAGEFPFFKAGQIYQKFECKGRFDGGQVVNVVRWSIPGLLQDGEGATLFVTAGFSVVSARTIQLEFKEARLGEVLISEELQALLAPAVLPRTFLNLQILQAINSLDVRVPLRGRRPSNERRSLGLLYYLTYLDNDMLLGRAIGSGGVFVFGKTQSF

SEQ ID NO: 246 - DNA, 867 bp, Trifolium pratense
atgggaatggacttggttttcaattcatcatcaccagtaccaccactattatgtagtagtagtagtagaaggcacacacacaacaactacaatttcaatttcaaatgcagcagcaatgttgttaataggaggaggaggaggaaattgttgtccatttccatggccatgccatctgctgctcaggcatatgattcagagttagagaacaaaaagcacgagcttttaacctctgtccgagacacacagaggggactcttaacaactcctcttcaacgttcttctatcgaggaagctcttgtgaatgtggaaggaacaaacttgggtcacccaattgatctcaacaagttggatgggacgtggcgcctacaatatacttccgcttctgatgttctcattctctttcaagctgctgctacacttccttttttccaagttggacagatatttcagaaatttgaatgtcgtgataactctaatggaggaggtgttattcgcaatattgtccaatggagtattccaaatttgttagaggaacaagaaggtgctacattgcttgtatctgccaagtttactcttgtatctgtccgtaatatctaccttcagtttcaagagatcacagttcaagatataaatattagtgaacagttgcaggctctaatagctccagcaatactacctcgatcttttataaatttgcagatcttgcaatatctccgtgctttcaaagctcaaattcctgtgagtccgggaagagaatcggtaggaggactatattacctgagttacttggatgataatatgcttttgggtcgtgctgttggtggaggaggtgtatttgtgtttacgagagcccaatcactttactaa

SEQ ID NO: 247 - protein, 288 aa, Trifolium pratense
MGMDLVFNSSSPVPPLLCSSSSRRHTHNNYNFNFKCSSNVVNRRRRRKLLSISMAMPSAAQAYDSELENKKHELLTSVRDTQRGLLTTPLQRSSIEEALVNVEGTNLGHPIDLNKLDGTWRLQYTSASDVLILFQAAATLPFFQVGQIFQKFECRDNSNGGGVIRNIVQWSIPNLLEEQEGATLLVSAKFTLVSVRNIYLQFQEITVQDINISEQLQALIAPAILPRSFINLQILQYLRAFKAQIPVSPGRESVGGLYYLSYLDDNMLLGRAVGGGGVFVFTRAQSLY

SEQ ID NO: 248 - DNA, 837 bp, Vitis vinifera
atgaacttggcatttgcttctacattgcaccttccaaccggacaaagagttggctatgacacaagatccgttagcttggcccctaatgccagcagagggctgtctactcagaaaatgtttccatgtttggcagctactgctacccccacgactcaggcagctgaatttgtgttagaggagaaaaaacatgatctgttgagagctatccaagacacacaacggggccttgttgcaactgcagatcaacgctcttgcattgaggaggccctagtaaatgtggaggagtacaatgctggtgtaccaattgatctgggaaagttagatgggacatggcgtctgcagtatacttccgcccctgatgtcctcgttcttctggaatctgctgcaaggttttcattctttcaggttgggcaaatcttccaaaaatttgaatgtcagaatcaatcaaaagaaggtgttgttcgcaatgttgttcggtggagtattccacccttattagaggagcaagaaggtgctactctgcttgtatctgcaaagttttctgttgtatctgcccgtaacatctaccttcagtttgaagagatatcaattcaaagtataaacatcagtgaggagctccaagctctgatagctccagcaatactaccacgttcttttttgagtctacagatcttgcagtttattcgtactttcaaagctgaaattcctgtgagaaaccaagggaggcgatcagttggagggctttattacctttcatatctggatgccaatatgcttttggggcgtgctgctgcaggtggaatatttgtgtttactagagctcaacctcttgtttga

SEQ ID NO: 249 - protein, 278 aa, Vitis vinifera
MNLAFASTLHLPTGQRVGYDTRSVSLAPNASRGLSTQKMFPCLAATATPTTQAAEFVLEEKKHDLLRAIQDTQRGLVATADQRSCIEEALVNVEEYNAGVPIDLGKLDGTWRLQYTSAPDVLVLLESAARFSFFQVGQIFQKFECQNQSKEGVVRNVVRWSIPPLLEEQEGATLLVSAKFSVVSARNIYLQFEEISIQSINISEELQALIAPAILPRSFLSLQILQFIRTFKAEIPVRNQGRRSVGGLYYLSYLDANMLLGRAAAGGIFVFTRAQPLV

SEQ ID NO: 250 - DNA, 876 bp, Zea mays
atggcgctcgcagccccttcttccctccgcctcctcccgaccacgccatcgcaggcgccatctccgccctgggcctcccgaccacgccatctgcgggagctccgtctctgccagagactcgccaccgccgccgccgccgccgccgccgccgcggccgcggccacggctccactcgcttcctcgcccaccacctccgcggacacggagcggaggaagcacgaactgctgcgcgcggttcaggaaacgcggcgcggattcgcagcggggcccgaccaacgcgctgccatcgaggaggccgtcgtggccgtggaggagcgtggtgcggggaagggaacgccgatagatctcgcggcgctcgatggcacctggaggctgtgttacacatcggcatcagacgtgcttgtgctgttcgaggcggccgagaggcttccactcctgcaggtgggccaaatataccagaaatttgagtgcaaagatcgatcagatggtggaactgtgaggaatgttgtaaggtggagcatcgagaacttgctggaggagcaagaaggtgcaacactgatggtctctgcgaagtttgttgtcctgtctaaacggaatatctttcttcaatttgaggaggtcgctgttgaaaatatcaagatcagcgagcaactgcagacactaatagctcctgctatacttcctcggtcatttttgagccttcagatattgcagttccttaaaacctttcgaactcaagttcctgttagtggtcctgaaagacgatcacctggaggattatattatctgtcttaccttgatcgtgatatgctcctgggtcgttcagttggtggtgggggaatatttgttttcacaaaggcacaacctcttacataa

SEQ ID NO: 251 - protein, 291 aa, Zea mays
MALAAPSSLRLLPTTPSQAPSPPWASRPRHLRELRLCQRLATAAAAAAAAAAAATAPLASSPTTSADTERRKHELLRAVQETRRGFAAGPDQRAAIEEAVVAVEERGAGKGTPIDLAALDGTWRLCYTSASDVLVLFEAAERLPLLQVGQIYQKFECKDRSDGGTVRNVVRWSIENLLEEQEGATLMVSAKFVVLSKRNIFLQFEEVAVENIKISEQLQTLIAPAILPRSFLSLQILQFLKTFRTQVPVSGPERRSPGGLYYLSYLDRDMLLGRSVGGGGIFVFTKAQPLT

SEQ ID NO: 252 - protein, 83 aa, Artificial sequence
  PF04755 from SEQ ID NO: 205
ENRKYELLNIIQDTQRGLVTTADQRSTIEEAMVVVEGFDAGKEIDLSKLDGTWRLQYTSAPDVLILFESAARLPFFQVGQIFQ

SEQ ID NO: 253 - protein, 137 aa, Artificial sequence
  C-terminal domain from SEQ ID NO: 205
KFECQNESRGGLVRNVIKWSVPRLLEENEGATLIVTARFSSVSARNIYLKFEEIGLQNINISDDLQAVIAPAILPRSFLSLQILQFIRSFKARVPVTSPERHSVGGLYYLSYLDKNMLLGRAVGGGGVFIFTRAHTL

SEQ ID NO: 254 - protein, 50 aa, Artificial sequence
  domain X
  VARIANT (7)..(7): / replace = "Gln"
  VARIANT (9)..(9): / replace = "Ala"
  VARIANT (11)..(11): / replace = "Leu"
  VARIANT (13)..(13): / replace = "Asp"
  VARIANT (19)..(19): / replace = "Gln"
  VARIANT (24)..(24): / replace = "Leu"
  VARIANT (28)..(28): / replace = "Leu"
  VARIANT (35)..(35): / replace = "Asn"
  VARIANT (41)..(41): / replace = "Ala"
  VARIANT (42)..(42): / replace = "Ile"
  VARIANT (43)..(43): / replace = "Lys"
  VARIANT (44)..(44): / replace = "Ser"
  VARIANT (46)..(46): / replace = "Arg"
  VARIANT (49)..(49): / replace = "Ile"
NIYLQFEEISVQNINISEELQALIAPAILPRSFLSLQILQFLRTFKAQVP

SEQ ID NO: 255 - protein, 21 aa, Artificial sequence
  domain Y
  VARIANT (4)..(4): / replace = "Thr"
  VARIANT (8)..(8): / replace = "Asn"
  VARIANT (9)..(9): / replace = "Asp"
  VARIANT (15)..(15): / replace = "Ser"
YYLSYLDRNMLLGRAVGGGGV

SEQ ID NO: 256 - protein, 21 aa, Artificial sequence
  domain Z
  VARIANT (1)..(1): / replace = "Ala"
  VARIANT (2)..(2): / replace = "Leu"
  VARIANT (5)..(5): / replace = "Ser"
  VARIANT (19)..(19): / replace = "Pro"
PIDLAKLDGTWRLQYTSASDV

SEQ ID NO: 257 - DNA, 2194 bp, Oryza sativa; identical to SEQ ID NO: 85

SEQ ID NO: 258 - DNA, 54 bp, Artificial sequence
  primer: prm10420
ggggacaagtttgtacaaaaaagcaggcttaaacaatgatttcagcaggtttcg

SEQ ID NO: 259 - DNA, 50 bp, Artificial sequence
  primer: prm10421
ggggaccactttgtacaagaaagctgggtggctggttagcaaataagagt

SEQ ID NO: 260 - DNA, 732 bp, Populus trichocarpa
atgggaactcaaaagcctgcatggttggaagctctttacgcacagaagttctttgtggggtgctcttatcatgaaactgcgaagaagaatgaaaagaacgtgtgttgtttggattgttgcattagtatttgccctcattgtataccatctcatcgcttccataggctccttcaagttcgtcgttatgtttatcatgatgttgtccgattagaagacatcgaaaagctgatagattgctcaaatgttcaggcctatactataaatagtgctaaagtggtgtttatcaagaagagacctcagaacaggcaattcaaaggggccggaaactattgtacttcctgtgacagaagccttcaagaaccctttgcccattgctctcttggctgcaaggtggactttgtgctgaaacattacaaggatctttctccatacttgaggagatgcaacacattaactcttgggcctgacttctttatccctcaagatttagcagatgatgagatgaccaatgagacacctcattcaacaatcgtggactccgatgagccaatgagctggtcttcgagttcatcgggctccgaaaacatgagcatggccagcagtgagattgtacggaagaagagaagtggattatacgtatgtgcaagatcgatgaataaggtttctgatgaggacattgcttcgagcatgagtaggagaaaaggcattcctcatcgatctcctttatgttag

SEQ ID NO: 261 - protein, 243 aa, Populus trichocarpa
MGTQKPAWLEALYAQKFFVGCSYHETAKKNEKNVCCLDCCISICPHCIPSHRFHRLLQVRRYVYHDVVRLEDIEKLIDCSNVQAYTINSAKVVFIKKRPQNRQFKGAGNYCTSCDRSLQEPFAHCSLGCKVDFVLKHYKDLSPYLRRCNTLTLGPDFFIPQDLADDEMTNETPHSTIVDSDEPMSWSSSSSGSENMSMASSEIVRKKRSGLYVCARSMNKVSDEDIASSMSRRKGIPHRSPLC

SEQ ID NO: 262 - protein, 39 aa, Artificial sequence
  First Zn-binding region
  UNSURE (2)..(3): Unknown amino acid
  UNSURE (5)..(15): Unknown amino acid
  UNSURE (17)..(18): Unknown amino acid
  UNSURE (20)..(23): Unknown amino acid
  UNSURE (24)..(24): Xaa can be no amino acid or an unknown amino acid
  UNSURE (26)..(27): Unknown amino acid
  UNSURE (29)..(31): Unknown amino acid
  UNSURE (32)..(35): Xaa can be no amino acid or an unknown amino acid
  UNSURE (37)..(38): Unknown amino acid
CXXHXXXXXXXXXXXCXXCXXXXXCXXCXXXXXXXHXXH

SEQ ID NO: 263 - protein, 20 aa, Artificial sequence
  Second Zn-binding region
  UNSURE (2)..(3): Unknown amino acid
  UNSURE (5)..(14): Unknown amino acid
  UNSURE (15)..(15): Xaa can be no amino acid or an unknown amino acid
  UNSURE (17)..(19): Unknown amino acid
CXXCXXXXXXXXXXXCXXXC

SEQ ID NO: 264 - protein, 21 aa, Artificial sequence
  Motif 10
  VARIANT (1)..(1): / replace = "Ile"
  VARIANT (5)..(5): / replace = "Val" / replace = "Ile"
  VARIANT (10)..(10): / replace = "Arg"
  VARIANT (12)..(12): / replace = "Ile"
  VARIANT (15)..(15): / replace = "Lys"
  VARIANT (16)..(16): / replace = "Glu"
  VARIANT (20)..(20): / replace = "Pro"
VQTYTINSAKVVFLNQRPQSR

SEQ ID NO: 265 - protein, 29 aa, Artificial sequence
  Motif 11
  VARIANT (6)..(6): / replace = "Val"
  VARIANT (7)..(7): / replace = "Ile"
  VARIANT (9)..(9): / replace = "Ile"
  VARIANT (12)..(12): / replace = "Ser"
  VARIANT (13)..(13): / replace = "Ser"
  VARIANT (18)..(18): / replace = "Ile"
  VARIANT (20)..(20): / replace = "Val"
  UNSURE (21)..(21): Unknown amino acid
  VARIANT (22)..(22): / replace = "Val"
  VARIANT (23)..(23): / replace = "Ile"
  VARIANT (27)..(27): / replace = "Leu"
  VARIANT (29)..(29): / replace = "Ile"
HRSHRLLQVRRYVYHDVVRLXDLQKLIDC

SEQ ID NO: 266 - protein, 11 aa, Artificial sequence
  Motif 12
  VARIANT (1)..(1): / replace = "Arg"
  VARIANT (4)..(4): / replace = "Cys"
  VARIANT (6)..(6): / replace = "Val"
KNEKNIFCLDC

SEQ ID NO: 267 - protein, 30 aa, Artificial sequence
  Motif 13
  VARIANT (5)..(5): / replace = "Pro"
  VARIANT (18)..(18): / replace = "Ile"
  VARIANT (24)..(24): / replace = "Gln"
HRSHRLLQVRRYVYHDVVRLEDLEKLIDCS

SEQ ID NO: 268 - protein, 28 aa, Artificial sequence
  Motif 14
  VARIANT (4)..(4): / replace = "Leu"
  VARIANT (7)..(7): / replace = "Tyr"
  VARIANT (10)..(10): / replace = "Ser"
  VARIANT (14)..(14): / replace = "Ile"
  VARIANT (19)..(19): / replace = "Tyr"
  VARIANT (20)..(20): / replace = "Arg"
  VARIANT (21)..(21): / replace = "His" / replace = "Tyr"
  VARIANT (24)..(24): / replace = "Val"
  VARIANT (25)..(25): / replace = "Gly"
FKGSGNSCTTCDRSLQEPFHFCSLSCKV

SEQ ID NO: 269 - protein, 41 aa, Artificial sequence
  Motif 15
  VARIANT (5)..(5): / replace = "Gly"
  VARIANT (7)..(7): / replace = "Tyr"
  VARIANT (8)..(8): / replace = "Ala"
  VARIANT (9)..(9): / replace = "Asp" / replace = "Gln"
  VARIANT (14)..(14): / replace = "Ala"
  VARIANT (16)..(16): / replace = "Pro"
  UNSURE (17)..(17): Unknown amino acid
  UNSURE (20)..(20): Unknown amino acid
  VARIANT (21)..(21): / replace = "Arg"
  VARIANT (22)..(22): / replace = "Arg"
  VARIANT (28)..(28): / replace = "Val"
  VARIANT (29)..(29): / replace = "Cys"
  VARIANT (31)..(31): / replace = "Val"
  VARIANT (34)..(34): / replace = "Ser"
  VARIANT (35)..(35): / replace = "Thr"
  VARIANT (39)..(39): / replace = "Gln"
AWLEALLTEKFFVGCSXHEXAKKNEKNIFCLDCCASICPHC

SEQ ID NO: 270 - protein, 50 aa, Artificial sequence
  Motif 16
  VARIANT (15)..(15): / replace = "Gln"
  VARIANT (22)..(22): / replace = "Ser"
  VARIANT (25)..(25): / replace = "Ser"
  VARIANT (31)..(31): / replace = "Ser"
  VARIANT (36)..(36): / replace = "Leu"
  VARIANT (48)..(48): / replace = "Ala"
RRYVYHDVVRLEDLEKLIDCSNVQAYTINSAKVVFIKKRPQNRQFKGSGN

SEQ ID NO: 271 - protein, 50 aa, Artificial sequence
  Motif 17
  VARIANT (9)..(9): / replace = "Ala"
  VARIANT (10)..(10): / replace = "Glu"
  VARIANT (14)..(14): / replace = "Ala"
  VARIANT (15)..(15): / replace = "Ala"
  VARIANT (18)..(18): / replace = "Phe"
  VARIANT (21)..(21): / replace = "Asn" / replace = "Thr"
  VARIANT (29)..(29): / replace = "Val"
  VARIANT (36)..(36): / replace = "Ile"
  VARIANT (43)..(43): / replace = "Leu"
  VARIANT (45)..(45): / replace = "Ala"
  VARIANT (48)..(48): / replace = "Val"
PAWLEALYTQKFFVGCSYHEHAKKNEKNICCLDCCTSICPHCVPSHRFHR

SEQ ID NO: 272 - protein, 51 aa, Artificial sequence
  Motif 18
  VARIANT (12)..(12): / replace = "Tyr"
  VARIANT (13)..(13): / replace = "Phe"
  VARIANT (18)..(18): / replace = "Asp"
  VARIANT (22)..(22): / replace = "Glu"
  VARIANT (23)..(23): / replace = "Tyr"
  VARIANT (24)..(24): / replace = "Ile"
  VARIANT (26)..(26): / replace = "Arg"
  VARIANT (27)..(27): / replace = "Gln"
  VARIANT (28)..(28): / replace = "Lys"
  VARIANT (33)..(33): / replace = "Ala"
  VARIANT (37)..(37): / replace = "Thr" / replace = "Arg"
  VARIANT (39)..(39): / replace = "Asn"
  VARIANT (40)..(40): / replace = "Ser"
  VARIANT (42)..(42): / replace = "Thr"
  VARIANT (44)..(44): / replace = "Ser"
  VARIANT (48)..(48): / replace = "Leu"
CTSCDRSLQEPFYIHCSLGCKVDFVLKHYKDLSPYLRPCKTLQLGPDFFIP

SEQ ID NO: 273 - DNA, 2194 bp, Oryza sativa; identical to SEQ ID NO: 85

SEQ ID NO: 274 - DNA, 57 bp, Artificial sequence
  primer: prm13426
ggggacaagtttgtacaaaaaagcaggcttaaacaatgggaactcaaaagcctgcat

SEQ ID NO: 275 - DNA, 56 bp, Artificial sequence
  primer: prm13427
ggggaccactttgtacaagaaagctgggtttttcctaacataaaggagatcgatga

SEQ ID NO: 276 - DNA, 669 bp, Arabidopsis thaliana
atgaatctgagtgagaagagaagaagtgaagaagtttggattgaaacactactgaactcagagttctttgggatatgtatgaatcataagtatcttagaaagaacgagaagaatgtgttttgcattgattgtaatgtggaaatatgcagacattgttgtaacacagttacagattctcatttcctccatcgtcgtcttcagatctgcaaatacgtttaccaagatgttattcgtctcctcgaaatccaaaactacttcgactgttccgagattcagacatataaaataaatggagagaaggcaatacatttgaattcaaggccacaagcaaaagatgcaagaccttcaacaaaagccaagaatggtgcttcatgtgtgacttgtaaaagatatattcaggatcatcctaatcttttttgctctatctcctgcaagatttcaactccttcaaaaaagcataaattttgtttttctccaaaactagaacagagtgttttggagaaagaacactctactcaagaaggaagcttagaagaaaaaaaatcgtgcacatcgtccctcactgatgtttcagaagattctgaagttttattgagtgatttttcatttagaccactcttgagaatactcaagagaaaaggaatttctcgaagatctcctttctattga

SEQ ID NO: 277 - protein, 222 aa, Arabidopsis thaliana
MNLSEKRRSEEVWIETLLNSEFFGICMNHKYLRKNEKNVFCIDCNVEICRHCCNTVTDSHFLHRRLQICKYVYQDVIRLLEIQNYFDCSEIQTYKINGEKAIHLNSRPQAKDARPSTKAKNGASCVTCKRYIQDHPNLFCSISCKISTPSKKHKFCFSPKLEQSVLEKEHSTQEGSLEEKKSCTSSLTDVSEDSEVLLSDFSFRPLLRILKRKGISRRSPFY

SEQ ID NO: 278 - DNA, 738 bp, Arabidopsis thaliana
atggaatctggagaatttcctgcatggcttgaggttctgttaaaagacaagtttttcaacgcttgtttggatcatgaagatgataagaagaacgagaagaacatattatgtatcgattgttgtcttaccatctgtcctcactgtctctcttctcatacctctcatcgtcttcttcagataagaagatacgtgtatagagacgttttgagggttgaagatggttctaagctaatggattgctctttaattcagccatacacaacgaacagttcaaaagttgtgttcatcaatgaacggcctcagtctcgacaatttcgtggttccggtaacatttgtatcacctgtgaccggagtctccagtctccttacctcttctgctgtctctcctgcaagattagtgacgtcataatgagacaaagaggactctcagggtttctccgcgtctgcaacgttcttgatttaaccgacgaagtcacgacaacgacaccgagttccactctcgagcccaccgggtcgaaccgaacatcttccgagtcaagtggtaacgaaggagaagacatgttctggtgtcaggcgctcgcttgcaccgccactactgaaatcgttaggaagaaaagaagcagcttgtcgacgacttgcaggagagtcacggaggtggtttcaacgactaacacggaagctccggtgaactttttaaaccgtcggaagaatccgccgcaacgcgccccgctttattaa

SEQ ID NO: 279 - protein, 245 aa, Arabidopsis thaliana
MESGEFPAWLEVLLKDKFFNACLDHEDDKKNEKNILCIDCCLTICPHCLSSHTSHRLLQIRRYVYRDVLRVEDGSKLMDCSLIQPYTTNSSKVVFINERPQSRQFRGSGNICITCDRSLQSPYLFCCLSCKISDVIMRQRGLSGFLRVCNVLDLTDEVTTTTPSSTLEPTGSNRTSSESSGNEGEDMFWCQALACTATTEIVRKKRSSLSTTCRRVTEVVSTTNTEAPVNFLNRRKNPPQRAPLY

SEQ ID NO: 280 - DNA, 753 bp, Aquilegia sp.
atggtgaattattctgttcttccactttggcttgcaactcttcttagagaaaagttcttcagtccttgtttggttcatgaaactatgaagaaaaatgagaaaaatatcttttgcttggattgttgcgtaagtatttgtcctcattgcttatctcctcataattctcacagactcttacaaataagaaggtatgtttatcatgatgttataagactagatgattgtgagaagcttattgattgtgactatgttcaatcttacattaccaacagcgcgaaagtaattttcataaaccaaagatctcagacaagaccctttagaggctctggaaacatttgcatcatttgtgacagaagcttgcaagaccctaatctcttctgttctctcgcttgcaaggttacccatttggttaaaactgaaggtggaatagcaaggcatttatatgaatgtgaatttcttccattgtcagaaggtattgatgatggacaaatgactcctgattccgttcttgaatcacctgattcaatgcttacttcatctggttcaagtgcaaatggaggtggtggtgttggtggagtagattgttgcagaactcttgcttgtactgcaactacagaaattgtaaagaaaaaacgaagtagcttatcggctcggaattcgtatcggccgacatgttctactgcatccgaaattgctgctatcatcatgatgaataggcgaaagggtaatccacagaggtctcctctttactga

SEQ ID NO: 281 - protein, 250 aa, Aquilegia sp.
MVNYSVLPLWLATLLREKFFSPCLVHETMKKNEKNIFCLDCCVSICPHCLSPHNSHRLLQIRRYVYHDVIRLDDCEKLIDCDYVQSYITNSAKVIFINQRSQTRPFRGSGNICIICDRSLQDPNLFCSLACKVTHLVKTEGGIARHLYECEFLPLSEGIDDGQMTPDSVLESPDSMLTSSGSSANGGGGVGGVDCCRTLACTATTEIVKKKRSSLSARNSYRPTCSTASEIAAIIMMNRRKGNPQRSPLY

SEQ ID NO: 282 - DNA, 669 bp, Citrus sinensis
atggtgggatgcagattgataatcaagaaggagaaggcaagtgattggctcacaacgctgctgaaaagccaattctttggtccatgtatggaccatctggaactgaagaagaatgagaagaacgtgttctgtatggactgcaatattggattctgtaggaattgtgaggacaatcacagccgccaccgccgccttcagatctgcaaatacgtttaccaagacgtcgttcgtttccaagacatgcagaaacaccttgactgctccaaaattcagacatataaaatcaatggtgaaaaagctgtgcatttgaatcctcggcctcagttgaaagatgcaaagccatcaacaaaatcaaagactggcggttcttgtgaagcttgcggaagatacattcaagagttgccgaatcgcttctgctccattgcatgcaagcactgtgttgttccactgagccccaaagaccaaatccagaatggcattaatatcaccacattcccagttgagaaaatctggaatcaagaatcaagcacaagcgagaaggaatcgtccctgacgcagaacgatgcggcgtccgacgataatcgatccggcgagaatccggcgttgaggccaagaacaaatataagcaaaagaaaaggcatcccccgcagagctcatctcatcagttaa

SEQ ID NO: 283 - protein, 222 aa, Citrus sinensis
MVGCRLIIKKEKASDWLTTLLKSQFFGPCMDHLELKKNEKNVFCMDCNIGFCRNCEDNHSRHRRLQICKYVYQDVVRFQDMQKHLDCSKIQTYKINGEKAVHLNPRPQLKDAKPSTKSKTGGSCEACGRYIQELPNRFCSIACKHCVVPLSPKDQIQNGINITTFPVEKIWNQESSTSEKESSLTQNDAASDDNRSGENPALRPRTNISKRKGIPRRAHLIS

SEQ ID NO: 284 - DNA, 654 bp, Chlorella sp.
atggcgagtctgcaggacctgcagggctttgtacgcacggatagcttcttcacacaatgccccgcccacgccaccagcgctgcaagggaggcgcagctcaacttttacgattgctcaaaaaaccagccctgctgcgccctgtgtgtggcctcccagccgctggcgcccgtcttacaggtccgccgctccagctaccatgatgtggtgaagatggcagacatctcccgctacgcagacatcgggggcatccagggctacaccatcaacagctccaaggtcatcttcctgcgccgccgcccgcagccacggccgcccaagggcgccgtgggcgccagcctctgcaccgtgtgcagccgccacctgcaggacgtcagccactactgctcgctgcagtgcaagctggaccatctggagggcgtgaagcacgtgtcgctgcgcaagctggcgcccgccgccgccgacgacgccagccacagcagcggcagcagcgcgcgcagcagcggcggcgcccccgagacgccctcccacctcgactccctgcgcatgctggacgccgccgccgcctccagcgacagcgactgcacgggagccgacttccacggacaccccgccaagcggcgcaagggctgcccgctgcgtgccccctccacttag

SEQ ID NO: 285 - protein, 217 aa, Chlorella sp.
MASLQDLQGFVRTDSFFTQCPAHATSAAREAQLNFYDCSKNQPCCALCVASQPLAPVLQVRRSSYHDVVKMADISRYADIGGIQGYTINSSKVIFLRRRPQPRPPKGAVGASLCTVCSRHLQDVSHYCSLQCKLDHLEGVKHVSLRKLAPAAADDASHSSGSSARSSGGAPETPSHLDSLRMLDAAAASSDSDCTGADFHGHPAKRRKGCPLRAPST

SEQ ID NO: 286 - DNA, 1140 bp, Chlorella sp.
atgcaggcccactccctgctgccctcgggcgttatgctggaccatcccttcttctgcaaggcggcgccgcaggcggaaacccccacctccagcgccgatgaggccgatctgcacatcaagaacgtgatcaagagccctctcgccaagaatgaccagatctctgcggccaagcccagccccagcgacagcgaggtgtctgcaggcgtggacagccgccccgcggcgtgcggcgcgccaggcgtggtggaccagccgccgcctgctgccttctgcggcttccccgcagccgccgccgccgccgccatccccgaccccttcctcgccgggaccgccgcgccagcgcctggtagcggcgccagcagcccagccccttggctcatgggtctgttcaactcctcgctctttgaggccgccggctgccgctgccaccctggcgttgtgcgcaacggtaccatgaagcgcaacgagaacaaccagtactgcctgggctgcacgcacgcgcacggcgccggcatgtgcaagctctgcctgcccgcccacgccgcctgctgcccggggcgcgtcttccagatacgcaagtacatgtaccagacgtgcgtgcatgttgacgacatccagccactgtacgatgtgggcggggtgcaggcgtactgcatcaactcgcgccgcgcgaatgtggagaaggagcagaagtgccccgcctttgaccacgcctgcctgggctgccacaagccgctgcgccacgactgcacctactgctcgctgcgatgcaaggtggacgtggagtttgggctggcgcccatcacccccaggggcgcggccgcggccgcgcgcggcgacagcggcggcggcggcggcatggcgcccgcggcggcggcggcggcggcggcggcgatgctgctgaccacgcagccgcggcagcaggctgtgagcaggctggcatccgccaagcggtcgtcattcagcgccgccgccgcggtggcggctgccgctgtggcggcggcggcggcggcagtgctgcctgcggcctgctccctggatgtctcgcatgccacgcgctgcagcagcggcttcgaatcgggcagcacccgcagcaagcggcggaagacggagcggccggagcgcagccgcgtcagctga

SEQ ID NO: 287 - protein, 379 aa, Chlorella sp.
MQAHSLLPSGVMLDHPFFCKAAPQAETPTSSADEADLHIKNVIKSPLAKNDQISAAKPSPSDSEVSAGVDSRPAACGAPGVVDQPPPAAFCGFPAAAAAAAIPDPFLAGTAAPAPGSGASSPAPWLMGLFNSSLFEAAGCRCHPGVVRNGTMKRNENNQYCLGCTHAHGAGMCKLCLPAHAACCPGRVFQIRKYMYQTCVHVDDIQPLYDVGGVQAYCINSRRANVEKEQKCPAFDHACLGCHKPLRHDCTYCSLRCKVDVEFGLAPITPRGAAAAARGDSGGGGGMAPAAAAAAAAAMLLTTQPRQQAVSRLASAKRSSFSAAAAVAAAAVAAAAAAVLPAACSLDVSHATRCSSGFESGSTRSKRRKTERPERSRVS

SEQ ID NO: 288 - DNA, 711 bp, Gossypium hirsutum
atgctgttttcttcacatctacctcgttggcttcaagttcttcttactgagaaattcttcaacgcttgcataattcatgaagatgccaagaaaaacgagaagaatatatattgcttggactgttgtatcagtatttgccctaactgcttatcccctcacagctctcaccgcctcttacagataagaaggtatgtctatcatgatgttataaggctggatgatgcaacaagattaatggactgtgcttttgtccaatcatacataacaaatagcgcaaaagtgatatttataaaccaaaggccacaaacaagacagttcagaggctccggcaacttctgcaatacctgcgacagaagcctgcaagaaccttatctcttttgctctctctcctgcaaggttaatgatctgttaagaacagaagatggggtttcaaagttcctgttcgagtgcaatttcttacctttaccagaagcgggttcggaggattatggtttggtgacaccggactcagtccttgaaccatctggttcgaccgggtctggtgggtacggggaagtgtcactcacatccactgctacgacggaaattgtgagaaagaagaggagtagcttaaaagcatgtcgaccgacatgccctccgacagtatccgaagtttcgggaagtttgatgaaccggagaaagaaaactccccaacgagctccactctattga

SEQ ID NO: 289 - protein, 236 aa, Gossypium hirsutum
MLFSSHLPRWLQVLLTEKFFNACIIHEDAKKNEKNIYCLDCCISICPNCLSPHSSHRLLQIRRYVYHDVIRLDDATRLMDCAFVQSYITNSAKVIFINQRPQTRQFRGSGNFCNTCDRSLQEPYLFCSLSCKVNDLLRTEDGVSKFLFECNFLPLPEAGSEDYGLVTPDSVLEPSGSTGSGGYGEVSLTSTATTEIVRKKRSSLKACRPTCPPTVSEVSGSLMNRRKKTPQRAPLY

SEQ ID NO: 290 - DNA, 669 bp, Gossypium hirsutum
atggtggggtgtgggttgtacattaagaagaaaacagattggattagtacccttcttgaaagtgagttctttagtccttgctctgatcatcaagacctcaggaaaaatgaaaaaaacgtgttctgcatcgactgttgtctcgagttttgtcggcattgtaaggctcatagccagcaccggtggcttcaggtctgcaaatatgtatatcaagatgtcgttcgacttcaagaaatgcagaagcatctggactgttccaaaattcagacatacaaaatcaatggtgaaaaagctgtacatttgaatccaaggcctcaagctaaagatgccaaaccatcaacgaaatcgaaaacaggtgctgcatgtgaagcttgtagaagatatcttcaagacccacctaatcgtttttgttccattgcatgcaaggtatcagctgttgatgtgaagcctaaagaccaaagccataaaatggaattatcaatacaagaatatcatgaactttcatggaaagagaatcaaaatctggaaacaagttcagaagataagcaatcctcactctcctcaacagatctttcagaagaggagactaaaacatggttggtcaaaagtttaaagcctcggaaacgattgcacaaaaggaaaggcactcctctgagagctccccttacttaa

SEQ ID NO: 291 - protein, 222 aa, Gossypium hirsutum
MVGCGLYIKKKTDWISTLLESEFFSPCSDHQDLRKNEKNVFCIDCCLEFCRHCKAHSQHRWLQVCKYVYQDVVRLQEMQKHLDCSKIQTYKINGEKAVHLNPRPQAKDAKPSTKSKTGAACEACRRYLQDPPNRFCSIACKVSAVDVKPKDQSHKMELSIQEYHELSWKENQNLETSSEDKQSSLSSTDLSEEETKTWLVKSLKPRKRLHKRKGTPLRAPLT

SEQ ID NO: 292 - DNA, 717 bp, Glycine max
atgggggggcagaatctttccccaaaggaaaggagtagagattggattggagttcttatgaacagcagctttggttattgtacttatcaccatgatcttcgatctaatgagatgaatgtgttctgcgtggactgtgcacttaggatgtgtaggcactgtaaggaagctcattccctacatagaaggtttcagatttacaaatattcctaccaggatgtcttccgccatgccgagctgcagaagtattttgattgctccaaaattcagacttacatatccaataatgaaaggattgtgcatctcaaacctcggccttcaatcaccaaatctaagtctgctgatctaagtcccgactctaaatacaaagagaccggcatagcaacaagaccaaagtcagggggcacgtgtgaagaatgtggaaaacacttacaagatgagcgtaatcgcttctgctccattacatgcaagatctcagtgcatccagtggagacccaataccaaggtcaaaatcaatgttcaccaaaccaccaaagtgctagaggcatcatcaatccaaaacctgaaggcattgactttacaatgaatgataaccataattcagaaccggagtcatctatctctgaagctgagccatatgggtgggttgaagttgtgaatttcagaaagcgtccaaggaaaagtatccctcagaggcctgtctttgttttcacgtcttag

SEQ ID NO: 293 - protein, 238 aa, Glycine max
MGGQNLSPKERSRDWIGVLMNSSFGYCTYHHDLRSNEMNVFCVDCALRMCRHCKEAHSLHRRFQIYKYSYQDVFRHAELQKYFDCSKIQTYISNNERIVHLKPRPSITKSKSADLSPDSKYKETGIATRPKSGGTCEECGKHLQDERNRFCSITCKISVHPVETQYQGQNQCSPNHQSARGIINPKPEGIDFTMNDNHNSEPESSISEAEPYGWVEVVNFRKRPRKSIPQRPVFVFTS

SEQ ID NO: 294 - DNA, 678 bp, Glycine max
atgatggggcagaatcgttttccagaagaaaggaaaagagattggcttggtgcccttttgaagtgcggctttggatgttgtgaagaacacaaagacattaggtttaatgagaagaatgtgttctgcatagattgcgtagctggcttgtgtaggcactgcaaggaagctcattctctccatagaaggtttcagatatacaaatattcctatcaggatgttgtgcgccattatgatcttcagaagtattttgattgctcaaatattcagacttatgtgtccaacaatgaaaagattgtgcatctcagaccccggacttcaaccaaagaattcaagctaacaagaaaatccaagtttgataatctttgctctgagtctaatgccaaagaagtcaaagtagcaacacctccaaagtggggtggtacttgtgaagaatgtggaaagcatttacaagatgagcgcaatcgattctgctccattacatgcaagatctcagtgcttcctcaccatgcacaaaggattccagaggagggtgttgaccaacatgataaccaaaactccgaaactgagtcatctatatctgtagctgagccatatgaatgttttgaagtagtgactttaagaaagcgcccaaggaaagccaaccctcagaaaacatgttattttgtcttcccttgttga

SEQ ID NO: 295 - protein, 225 aa, Glycine max
MMGQNRFPEERKRDWLGALLKCGFGCCEEHKDIRFNEKNVFCIDCVAGLCRHCKEAHSLHRRFQIYKYSYQDVVRHYDLQKYFDCSNIQTYVSNNEKIVHLRPRTSTKEFKLTRKSKFDNLCSESNAKEVKVATPPKWGGTCEECGKHLQDERNRFCSITCKISVLPHHAQRIPEEGVDQHDNQNSETESSISVAEPYECFEVVTLRKRPRKANPQKTCYFVFPC

SEQ ID NO: 296 - DNA, 717 bp, Glycine max
atgggggggcagaatctttccccaaaggaaaggagtagagattggattggagttcttatgaacagctgctttggttattgcgattatcaccatgaccttcgatctaatgagatgaatgtgttctgcgtagactgtgcacttaggatgtgtaggcactgtaaggaagctcattccctacatagaaggtttcagatttacaaatattcctaccaggatgtcttccgccatgccgagctgcagaagtattttgattgctccaaaattcagacttacatatccaataatgaaaggattgtgcatctcaaacctcggccttcaatcaccaaatctaaatctgctgatctaagccccgactctaaatccaaagaaaccggcatagcaacaagaccaaagtcaggtggcacgtgtgaagaatgtggaaaacacttacaagatgagcgtaatcgcttctgctccattacatgcaagatctcagtgcatccagtggagacccaaaaccaatttcaaagtcaatgttcacaaaaccaccaaagtgctagaggcatcatcactccaaaacctcaaggcattgactttacaatgaatgataaccataattcagaaccggagtcatctatctctgaagctgagccatatgggtgggttgaagttgtgaatttcagaaagcgtcctaggaaaagtatcccgcagaggcctgtctttgttttcacgtcttag

SEQ ID NO: 297 - protein, 238 aa, Glycine max
MGGQNLSPKERSRDWIGVLMNSCFGYCDYHHDLRSNEMNVFCVDCALRMCRHCKEAHSLHRRFQIYKYSYQDVFRHAELQKYFDCSKIQTYISNNERIVHLKPRPSITKSKSADLSPDSKSKETGIATRPKSGGTCEECGKHLQDERNRFCSITCKISVHPVETQNQFQSQCSQNHQSARGIITPKPQGIDFTMNDNHNSEPESSISEAEPYGWVEVVNFRKRPRKSIPQRPVFVFTS

SEQ ID NO: 298 - DNA, 663 bp, Glycine max
atggttgggttcaactcagttcctaattggcttctcattcttaaggaagagaagttttttactcgctgtttgattcatcactctgtaaagaagaacgagaagaacattttctgcttagattgctgcacaagcatttgcctccactgcttgccctttcaccgctctcacgtccttttgcagataagaagatacatgtacaatgacgtattacgccttggtgatgctcagacattgttgaattgttcccttgttcaaccgtacacaacaaataaaactaaggttgtatttttgaaacaaaggcctcccaccggctctcacagaggctcgagcaacatttgcatcacatgtgaccgtaacctccaagacccatacatcttctgctctgtctcatgcaaggttcaattttcgtacaaagaaagaagcagcgagaaccaccaagaaatagaagatagccaaatcacaacagattcagtcctagactcacactcacccacgtcgacatcgttatgcaccgtgtctggatcaacaagtactaatagtgggagtgtgacagagaatgagtcactaaaaaagaaacgtggtagtgttgacatggtgccagagatttggtacacaatggtgaaccgccgaaaaggagtccctcatcgatctccattctactga

SEQ ID NO: 299 - protein, 220 aa, Glycine max
MVGFNSVPNWLLILKEEKFFTRCLIHHSVKKNEKNIFCLDCCTSICLHCLPFHRSHVLLQIRRYMYNDVLRLGDAQTLLNCSLVQPYTTNKTKVVFLKQRPPTGSHRGSSNICITCDRNLQDPYIFCSVSCKVQFSYKERSSENHQEIEDSQITTDSVLDSHSPTSTSLCTVSGSTSTNSGSVTENESLKKKRGSVDMVPEIWYTMVNRRKGVPHRSPFY

SEQ ID NO: 300 - DNA, 669 bp, Gossypium raimondii
atggtggggtgtgggttgtacattaagaagaaaacagattggattagtacccttcttgaaagtgagttctttagtccttgctctgatcatcaagacctcaggaaaaatgaaaaaaacgtgttctgcatcgactgttgtctcgagttttgtcggcattgtaaggctcatagccagcaccggtggcttcaggtctgcaaatatgtatatcaagatgtcgttcgacttcaagaaatgcagaagcatctggactgttccaaaattcagacatacaaaatcaatggtgaaaaagctgtacatttgaatccaaggcctcaagctaaagatgccaaaccatcaacgaaatcgaaaacaggtgctgcatgtgaagcttgtagaagatatcttcaagacccacctaatcgtttttgttccattgcatgcaaggtatcagctgttgatgtgaagcctaaagaccaaagccataaaatggaattatcaatacaagaatatcatgaactttcatggaaagagaatcaaaatctggaaacaagttcagaagataagcaatcctcactttcctcaacagatttttcagaagaggagactaaaacatggttggtcaaaagtttaaagcctcggaaacgattgcacaaaaggaaaggcactcctttgagagctccccttacttaa

SEQ ID NO: 301 - protein, 222 aa, Gossypium raimondii
MVGCGLYIKKKTDWISTLLESEFFSPCSDHQDLRKNEKNVFCIDCCLEFCRHCKAHSQHRWLQVCKYVYQDVVRLQEMQKHLDCSKIQTYKINGEKAVHLNPRPQAKDAKPSTKSKTGAACEACRRYLQDPPNRFCSIACKVSAVDVKPKDQSHKMELSIQEYHELSWKENQNLETSSEDKQSSLSSTDFSEEETKTWLVKSLKPRKRLHKRKGTPLRAPLT

SEQ ID NO: 302 - DNA, 726 bp, Medicago truncatula
atggtggggaaggatcaatcaccaaaggaaaggaatagagattggattagagctcttatgaatagtagctctggctattgtgatgatcatcgtgatcttcgatctaatgagaagaatactttctgtgtagattgtgctgttagattctgtaggcactgtaaggaagctcattccattcatagaaggtttcagatttaccgatattcctatcaggatgttttccgccattcggagctacagaagcactttgactgctcaaatattcagacttacatatccaataaagataggattgtgcatctcaaacctcggcctccaatctataagtctaaatctggtgatcaatgccctgaatcaaaatccaaagaaagcaacttatcagcaagatttaagtcaggaggtagtacatgcgaagaatgtgggaaacacttacaagatgagcatagtcgctggtgctcaattatatgcaagataggggagcctcaaagccaaggtccaaatcatcatacagaaaggagtttagttgactctttcaaccaaagtggtagatgcatcatcactccaaaaactgaagctattgactttactatgagtgataaccttaattcggaaccagagtcatctatttctgaagctgagccatgtgggcgggttgaagttgtgaatttcagaaagcgcccaagaaaaactactcctgagaggcctgtctttgttttcgtttcttag

SEQ ID NO: 303 - protein, 241 aa, Medicago truncatula
MVGKDQSPKERNRDWIRALMNSSSGYCDDHRDLRSNEKNTFCVDCAVRFCRHCKEAHSIHRRFQIYRYSYQDVFRHSELQKHFDCSNIQTYISNKDRIVHLKPRPPIYKSKSGDQCPESKSKESNLSARFKSGGSTCEECGKHLQDEHSRWCSIICKIGEPQSQGPNHHTERSLVDSFNQSGRCIITPKTEAIDFTMSDNLNSEPESSISEAEPCGRVEVVNFRKRPRKTTPERPVFVFVS

SEQ ID NO: 304 - DNA, 735 bp, Medicago truncatula
atgacaattggaatggatatgatgttggtaccctggttagcaaaattgctggcaatcactactttttttacaacatgtgaagtccacccaagagagtcgaaaaatgagtgcaacaagttctgcctcgattgcaatgacaatccattatgtggatcttgcataaaatattgtcacaaagatcaccgagtaatccaaataaggagatcgtcatacaatgaagcagttaagaccactgaaatttacaagcatgttgacatccttggaattcaaacctatgtgattaatagctctactgttgtattcttaaacaagagagctcgtgcccaacctaagaggtacaagattggtaaaattggtcacactagcgactctctttgtaagacatgcgatagaaatctcgtggattatacctacttttgctctttggcatgcaaggagggaggatttttcataagcacaaaagagatggaagcaatggaaatattactgcatgaatcaatcaaggtatcagcaccaaaagaaaaagctaaaatatcacgtgaacaaaatcggaaacgaaaacaagaagaagcaggaattgatgaagaaaatgaagagggggaagaggaagaagaaaaagaagaaggcgacgacaacaatgaaagtatgcttcgtgtaattaatcgctcatcatcttcattacgcaagtccaattcaagaagaaaaggaataccttatagggcacctttattttaa

SEQ ID NO: 305 - protein, 244 aa, Medicago truncatula
MTIGMDMMLVPWLAKLLAITTFFTTCEVHPRESKNECNKFCLDCNDNPLCGSCIKYCHKDHRVIQIRRSSYNEAVKTTEIYKHVDILGIQTYVINSSTVVFLNKRARAQPKRYKIGKIGHTSDSLCKTCDRNLVDYTYFCSLACKEGGFFISTKEMEAMEILLHESIKVSAPKEKAKISREQNRKRKQEEAGIDEENEEGEEEEEKEEGDDNNESMLRVINRSSSSLRKSNSRRKGIPYRAPLF

SEQ ID NO: 306 - DNA, 987 bp, Ostreococcus lucimarinus
atgagacctagcgcgcgcggcgacggcggactgacgacgcgcgcgcgagcgacgacggcgcgcgaacgctctcagggagcgaaggcgcaattacccaaagagttatcatggatccccgatctcgtgcacggcgcgttcttcgcgccgtgcgacgtgcacagcacggggagcaaaggcgagcaagtcaatttgttctcgttatcgtcacgacgctcgatgtgtccggcgtgcgcggcggagcgcgacgtgttcgacacgatacagattcgaaggagttcgtatcataacgtcgtgcgcgtgcaagacgtgtgtaagctcatggacgtgacgggtatacagacgtacatcatcaactcggcgcgcgtcgtgtttttaaacgaacgcccgcacccgcggtcgacgaataaaaaagacggggaaaagctgatgaatcattcgtcgtcgagcgggcgcggcgcggggagtggcgaacgatatcgcgcgggcgcgggcgcgcaggcgcaaatgcactcggagtgttcgtattgcgcgcgcattcttcagagcgacaacaacaagtattgctcgatttcgtgcaagatgaacggcggcgaagatatgagcgccaagggcgggatagacatgtcgtacgcggaggaaacgatcaagccgacgccgcggaagagtacgcaggccaaaaatgccgccaaggctgagaaggcgaatagcgaccgacggtcaccggctcgaaacaagtcacccgcgagcgacactagcaccaagcgcgctcgcggctattcgcccgtctcggtgaagagcgaagacgaatactcgccctcgagcgaaggcgcgacgccgatgcgagcggtggcggcggcgacgactgggaaacgtaaatatagctcaaaggatcgaaacggcgacgcgccggtgacgccgacgcttctcatcgtcacgcccgcggtgccgcatcggcgcaagagtaagccgaaaaaatcgcctcactga

SEQ ID NO: 307 - protein, 328 aa, Ostreococcus lucimarinus
MRPSARGDGGLTTRARATTARERSQGAKAQLPKELSWIPDLVHGAFFAPCDVHSTGSKGEQVNLFSLSSRRSMCPACAAERDVFDTIQIRRSSYHNVVRVQDVCKLMDVTGIQTYIINSARVVFLNERPHPRSTNKKDGEKLMNHSSSSGRGAGSGERYRAGAGAQAQMHSECSYCARILQSDNNKYCSISCKMNGGEDMSAKGGIDMSYAEETIKPTPRKSTQAKNAAKAEKANSDRRSPARNKSPASDTSTKRARGYSPVSVKSEDEYSPSSEGATPMRAVAAATTGKRKYSSKDRNGDAPVTPTLLIVTPAVPHRRKSKPKKSPH

SEQ ID NO: 308 - DNA, 840 bp, Ostreococcus sp. RCC809
atgacgcttccgaacgaattggcgtggattcccgatctcgttcgcggcgtcttcttcgccccgtgcgagagacacagcgccgggagcaagggtgagcaagttaacttgttctccgtgtccggcagacgcgcgatgtgcgcggcgtgtgcggcggagacgtcggtgaaggatgcgatacagattcggagaagttcgtatcacaacgtcgtgcgcgtgcaggacgtgtacagattgatggatgtgtcgagcattcaaacgtacatcattaattcagcgcgcgtggtgtttctgaacgagcgaccgcacccgagatcgaacaagggtaaagaggacaaggcgagaagcgaacgatctcgagcgacgacgatggcgcactccgagtgcgcgtattgcgcgcgaattctgcagagtgaaaacaataactattgttcaatctcgtgtaaactgaacggaggagattgtatggtccccaaggcgggcgtcgacatgtcgttcgcggaggagaccatcaaaccgacgccgaggaagagcacgcaaacgaagagcgccaaggacaatagacgaggccgcaaagggtctccagccagcgataacagtagcaagagcgctcgcagtagatcaccggtatcggtcaagagcgaagacgaaccgacgaacagtagccacggtggatcgccgattctcaaaatcgccgccggcgcgctcctcgtcggctcgaagcgcaagcacccgacgtcgaggggcgacgcgcccgcgacgccggcgcctctcctcatcactccatcggttcttcaccgacgcaagagccgtccgaagaagtccccggtgggtgatcactga

SEQ ID NO: 309 - protein, 279 aa, Ostreococcus sp. RCC809
MTLPNELAWIPDLVRGVFFAPCERHSAGSKGEQVNLFSVSGRRAMCAACAAETSVKDAIQIRRSSYHNVVRVQDVYRLMDVSSIQTYIINSARVVFLNERPHPRSNKGKEDKARSERSRATTMAHSECAYCARILQSENNNYCSISCKLNGGDCMVPKAGVDMSFAEETIKPTPRKSTQTKSAKDNRRGRKGSPASDNSSKSARSRSPVSVKSEDEPTNSSHGGSPILKIAAGALLVGSKRKHPTSRGDAPATPAPLLITPSVLHRRKSRPKKSPVGDH

SEQ ID NO: 310 - DNA, 894 bp, Oryza sativa
atggctgctgggttggcggagcgggagccggcgtggctgcggtcgctgctcggcgcgcggttcttcgaggcgtgcgcggcgcaccgcggcatgagcaggaacgagtgcaaccagtactgcctcacctgcgccgcggccgccgacgacgccggcggcgcggccgccgtggggtgccagtggtgcgtggtggcggcgcacggcggcggcgcggggcgggatcgcggccaccgccaccgggtggtccaggtgcggaggtcgtcgtaccacaacgtggtgcgcgtgtcggagctggagcgcacgctggacctgacgcgggtgcagacctacgtcatcaaccgcgacagggtcgtcttcctcaacgagcgcccgcaggcgccgcgcaacggccggtgcgccgccgccgccgccgtggcgtgcgccgcctgcgaggcgtgcggccgcggcctcctcgacgtcgccttccgcttctgctccctcggctgcaagctgaaatgcatggaatcggatcctaccctgacattcaccatcgatcccaacaacatcccagagccacagatttcagggccacaggaagacgaggaagaagacgacgacgaagaagacgagccgttctacccaaccaaggcgaacgctgctcagagcaaggccgcgggcggcggcggctgccggccgccgccgccgccgtccgcgtcgtcgtcgcgacctaggagaggaggacgccgggtggctagaggcgacaaggaagaggatcaggaggccgccgccaacatcctcgccttcgccgccgccgcggcgcggtcggtgccggccgcctccgccgccgaccccaacagctaccggcggcgcgctaggaagggcgcgcaccgcgcgccggagcggtcgccgttcttctga

SEQ ID NO: 311 - protein, 297 aa, Oryza sativa
MAAGLAEREPAWLRSLLGARFFEACAAHRGMSRNECNQYCLTCAAAADDAGGAAAVGCQWCVVAAHGGGAGRDRGHRHRVVQVRRSSYHNVVRVSELERTLDLTRVQTYVINRDRVVFLNERPQAPRNGRCAAAAAVACAACEACGRGLLDVAFRFCSLGCKLKCMESDPTLTFTIDPNNIPEPQISGPQEDEEEDDDEEDEPFYPTKANAAQSKAAGGGGCRPPPPPSASSSRPRRGGRRVARGDKEEDQEAAANILAFAAAAARSVPAASAADPNSYRRRARKGAHRAPERSPFF

SEQ ID NO: 312 - DNA, 897 bp, Oryza sativa
atgctctcaaaaatgcatatgaaatggttttcctttttagaatggccaagtgccacctttgcctctagcttcataaaaacccagtcctctttggcacagtactatttgctcatgttcgtgaaaatcattgagctctgcaagcttaagggtaaggagaccagggcggagccggaggtttccagcgtcagcaaggcctcggggggcagcagcgagcacatcaacaagctgccaccgccggtgccggtgcaggaggaggaggaggcgccggaatggctggacgtgctgctgcggacgaaattctgggggcagtgcaagcagcactgggacgcgagccgcgcggaggtttgcatcttctgcctccgctgccgccaggtgctctgcccgcgctgcagccatgacgagcccggccaccggctgctcaaggtccgccgctacatgtaccgctccgtcgttctcgccagggacttgcagggcctcaacgttgacgtgtccagggtacagacatacattgtcaatggccaaaagggcgtgcacctgaggcccatgaggaggtccccgcaattcaagcctcacgttggtgtagatatatctcaggatgatttctcaggacctgaagctgagcgtaggcataagcagactctgggaattgtggtggagtcatctcctcaacagagcatcccacaaccatttgatgcctcacctgtgagaaatgaagatgccaccatggttgaagctgagtgtggtcaagttcagacgaatgcgacggagtcggagtcgtcagcggtaggagatgcagatgaggttatacctaaagttactaagttcaatgttgatatccactctttgaggaggcgagttcgcaagcaggcggcaccacagagggcccccttcttctga

SEQ ID NO: 313 - protein, 298 aa, Oryza sativa
MLSKMHMKWFSFLEWPSATFASSFIKTQSSLAQYYLLMFVKIIELCKLKGKETRAEPEVSSVSKASGGSSEHINKLPPPVPVQEEEEAPEWLDVLLRTKFWGQCKQHWDASRAEVCIFCLRCRQVLCPRCSHDEPGHRLLKVRRYMYRSVVLARDLQGLNVDVSRVQTYIVNGQKGVHLRPMRRSPQFKPHVGVDISQDDFSGPEAERRHKQTLGIVVESSPQQSIPQPFDASPVRNEDATMVEAECGQVQTNATESESSAVGDADEVIPKVTKFNVDIHSLRRRVRKQAAPQRAPFF

SEQ ID NO: 314 - DNA, 762 bp, Oryza sativa
atgcttccttctcccgacgatagcagcagctcgtccccttccagtaagactaatccaagtgagaagggggaggaaattacggtggtggaggaaccaatactgttcgacaacaatcaagaggaggacaacagttcaaacccactgaatctattggctgatacatcagagttgtttcggaacatggatgatgatgagtcacccctgtggctgaacgtactgctgagaaccatattctggaggaagtgtgacgtgcatgagcagcttgagaatgcacatagggctgaggaaagcatcttctgcatcaactgcctcaagacaatatgcccacactgcacacatgatgaaccgagccaccaactcctcaaggtccgccgctacatcttccgcagcgtcgtccgcgtcaaggacatgcagaattttgggattgacatgtcttacatacagacattcaaatgcaatgggcacaaggtagtgcacctaaggcccataaagaggtcagaacatcatagacctaaagctggaacacctcattgcacgagttgccactgctggctacacaatgcacccagccttacctgttcacttagctgcaagaaaaaggcaggcatatcctcagatgacttctcagggcctgaagcttcaactcgagtttctcgttcacgaaatcatgcatcaaatgtcaatcagaaacatccaaccaatacgaagctgcgtaaaaagcctcgcaagcaagcaaaccctgaaagggctccattcttctga

SEQ ID NO: 315 - protein, 253 aa, Oryza sativa
MLPSPDDSSSSSPSSKTNPSEKGEEITVVEEPILFDNNQEEDNSSNPLNLLADTSELFRNMDDDESPLWLNVLLRTIFWRKCDVHEQLENAHRAEESIFCINCLKTICPHCTHDEPSHQLLKVRRYIFRSVVRVKDMQNFGIDMSYIQTFKCNGHKVVHLRPIKRSEHHRPKAGTPHCTSCHCWLHNAPSLTCSLSCKKKAGISSDDFSGPEASTRVSRSRNHASNVNQKHPTNTKLRKKPRKQANPERAPFF

SEQ ID NO: 316 - DNA, 666 bp, Populus trichocarpa
atgtcgcaggtaggttgcaaactttatgtaaagaacacaaattggctcagcactcttttccatagcgagttctttgattcttgtggtctgcatcaagaacacagaaagaacgagaaaaacgtgttttgcatcgattgcagagttgggtgctgtcgacattgtatggaatctcattttcttcatagacaatttcagatctgcaaatatgtttatcatgatgttgttcgccttcaagagattcaaaaacatcttgactgttctaaaattcagacttacaagatcaatggtgaaaaggctattcatctgaaaccacggcctcagcctaaagatgcaaggccatccacgaaagcgaagcttggtgcttcttgtgaagcatgtgcaagatatctacaagatgtccccaatcgcttctgctccattgcatgcaaggtttcagtggagcttaaagatcaaagccacaatatcatccccttctcaattcaggaatttcctgacctttcctggaaggaaaactgcagtgcagaaaggcattcaagtgagaacgaatcgtcactttctttgactgatatgtctgaggatactccaggttggatcaattcagctttgaaaccaagaagacaattgcacaagagaaaaggcgtcccacgtagggctcccctctgctag

SEQ ID NO: 317 - protein, 221 aa, Populus trichocarpa
MSQVGCKLYVKNTNWLSTLFHSEFFDSCGLHQEHRKNEKNVFCIDCRVGCCRHCMESHFLHRQFQICKYVYHDVVRLQEIQKHLDCSKIQTYKINGEKAIHLKPRPQPKDARPSTKAKLGASCEACARYLQDVPNRFCSIACKVSVELKDQSHNIIPFSIQEFPDLSWKENCSAERHSSENESSLSLTDMSEDTPGWINSALKPRRQLHKRKGVPRRAPLC

SEQ ID NO: 318 - DNA, 669 bp, Populus trichocarpa
atggtaggctgcaaaatttatgtaaaaaacacggattggctcactactcttctccatagcgatttctttgattcttgcagcaaccatcaagaacgtagaaagaacgagaaaaacgtgttctgtatggattgcagtgttgggtgttgtcgacattgtatggagtctcattgccttcatagacaactccagatctgcaaatatgtttaccatgatgttgttcgccttcaagagattcaaaaacatctagattgctctaaaattcagacctataagatcaacggtgaaaaggctattcatctgaaaccacggcctcagtctaaagatgcaagaccatccacgaaagcaaagttcggtgcttcttgtgaagcatgtgcaagatatctgcaagatgttcccaatcgtttctgctccattgcatgcaaggtttcagctgtttcagtggagcttaaagatcaaagccatgaaatcatctccttatcaattcaggaatttaccaacctttcctggaaggaaaaccccaatgcagaaaagcattcaagtgagaacgaatcgtcactttccttgactgatatgtctgaggatactcaaggctggatgaattcagctttgaaaccaagaagacaattgcacaagagaaaaggcgtccctcggagggcgccactatgttag

SEQ ID NO: 319 - protein, 222 aa, Populus trichocarpa
MVGCKIYVKNTDWLTTLLHSDFFDSCSNHQERRKNEKNVFCMDCSVGCCRHCMESHCLHRQLQICKYVYHDVVRLQEIQKHLDCSKIQTYKINGEKAIHLKPRPQSKDARPSTKAKFGASCEACARYLQDVPNRFCSIACKVSAVSVELKDQSHEIISLSIQEFTNLSWKENPNAEKHSSENESSLSLTDMSEDTQGWMNSALKPRRQLHKRKGVPRRAPLC

SEQ ID NO: 320 - DNA, 798 bp, Sorghum bicolor
atgaagggaaaggagattgttccggaggaggagtctgatgggtatgagtcggattttaatttggagtcggattttgatttggtgttggattcagaggaggagcaggagcaagagcaggagcaggagcaggagcaagagcaagagcaagagaagacaaagaagcccacatggctggaagcgctattgagaactaagttctgggatccatgcaaggagcatgggtccaagaacagggcggaccagtgcatgttctgcctcaaatgctttaaggtgacatgtcctcgctgcacccacagtaagctcggacaccgccgcctcaagatccgccgctacgtttaccgctctgtggtccatgcttccgacatgcaggagcgtggcattgatgtctccaagatacagacatatgttattaatgcaagaaaagtggtgcatctgaggcccatgaacagatccaagcattataggcctcaggcagggacacctcgctgcataacctgtaggacctggctccgtagcactcccaacttgtactgctcgcttgtctgtgagggaaattttaatatatcacaagacgacttctcggggcctgaagctgagcttcgttacaggagcgtccaagtgcatatgtctgatgaaccatcaggagctgctgctgaggagctgcctgattctgaagcagagccagagatgcctgcacaagttgatgagccaccgccgctgccggtcgcaaatcagaacgcgtcactccggaagcgggcgcgtaagcaggcgaagccagagagagcaccattcttttga

SEQ ID NO: 321 - protein, 265 aa, Sorghum bicolor
MKGKEIVPEEESDGYESDFNLESDFDLVLDSEEEQEQEQEQEQEQEQEQEKTKKPTWLEALLRTKFWDPCKEHGSKNRADQCMFCLKCFKVTCPRCTHSKLGHRRLKIRRYVYRSVVHASDMQERGIDVSKIQTYVINARKVVHLRPMNRSKHYRPQAGTPRCITCRTWLRSTPNLYCSLVCEGNFNISQDDFSGPEAELRYRSVQVHMSDEPSGAAAEELPDSEAEPEMPAQVDEPPPLPVANQNASLRKRARKQAKPERAPFF

SEQ ID NO: 322 - DNA, 579 bp, Sorghum bicolor
atggtcagcctgaaggagatggctcggtccgataaggagcgcgccccgccagcatggctgcatacgctactggcgacaacgttctttgatgcatgcccggagcacttggaaagcgagggctgtgctaacaggaggaccgctactagctgcaacttcttctgcactcactgtgctggccatgccctttgctctagctgcctcgacaaccatgaaggccatgaactcatccagatccggaagttatcaggccacaatgctgtgaaggtagacgacattcagcatctgctaagcgtgtcatttgtgcagacctacctctacaatggaggctatgccgtgttcctaaacagacggcctatgtatggtctgggaaatcatggtgtgtctcactgtgaggaatgcgaaaggggacttctggataaggcttaccgcttctgctcatttgggtgcaaggctgaaggaatagaggaccgacttgattttaacgtctcatttgctgtcaatccaaacaaatatgagacagaatcagatgacaacgaaggttcattttcagaagctgggtaccacatgagcatcgtgtag

SEQ ID NO: 323 - protein, 192 aa, Sorghum bicolor
MVSLKEMARSDKERAPPAWLHTLLATTFFDACPEHLESEGCANRRTATSCNFFCTHCAGHALCSSCLDNHEGHELIQIRKLSGHNAVKVDDIQHLLSVSFVQTYLYNGGYAVFLNRRPMYGLGNHGVSHCEECERGLLDKAYRFCSFGCKAEGIEDRLDFNVSFAVNPNKYETESDDNEGSFSEAGYHMSIV

SEQ ID NO: 324 - DNA, 618 bp, Selaginella moellendorffii
atgcgttccaaagttcccagagaaggcccggcctgggtggacgagttcctgtccggcgactacttcaccagctgcgacttccacaccggcggcaagaacgagcgcaaccagttctgcaccgaatgctccggcagcggccccctctgccagttcggcctcctcgcctcgcactcgggccaccggactctccaagtccgcaaggcctcacacatggactccatccgggtcgtggacatccagcagtgcctcgaggtctcggacatccagacgtactccatcaacagcgccaagatcgtattcctgctcagccgtccacagccccgtcccagcaaaggagctctccacgcctgcctgtgctgcaaccgggctctctcggacgacgtcaagttctgctcgcttgcatgtaagctggacgtgctgagggagcagccggaggacagatccatcacgtttgcattgccggccgatggggaggaggagaatggatccggctgcttcaaaaggaagaacagtgaggcattccaggattcgcccaccacacctgaaaagttcgagtcaatttccactgcgaaagctcgatgcagaaaaggcgtacctcgtagagcaccgatggggtag

SEQ ID NO: 325 - protein, 205 aa, Selaginella moellendorffii
MRSKVPREGPAWVDEFLSGDYFTSCDFHTGGKNERNQFCTECSGSGPLCQFGLLASHSGHRTLQVRKASHMDSIRVVDIQQCLEVSDIQTYSINSAKIVFLLSRPQPRPSKGALHACLCCNRALSDDVKFCSLACKLDVLREQPEDRSITFALPADGEEENGSGCFKRKNSEAFQDSPTTPEKFESISTAKARCRKGVPRRAPMG

SEQ ID NO: 326 - DNA, 768 bp, Vitis vinifera
atgaaaatggttggttttggttgtgatattcctcactggcttgaaattcttctgggggagaagttctttaacgcgtgtgtggttcatgagtgcgctaagaagaacgagaagaacatcttttgcttggactgttgcaccagcatctgcccccactgtttgctccctcaccgccatcaccgccttctacagatacggaggtacgtttatcacgacgttatacggttggatgatgctcaagagctgatggattgttctcttgttcaatcatacacaacaaacagtgcaaaagtggtgtttttgaaccaaaggcctatgtctcggccctttagagggtccggcaacctctgctacacctgcgaacgaagcttgcaagacccatatctcttctgctctctcgcatgcaaggttcatcacacgatgaacgtcaaaggtagtgccacaaaacacctccacaactttgaattccttccattacctgatagagcacgaggcgaggccttttccgagctcgacgaccgccaaatgaccccagaatccgtcctcgactcccctgtttctctccgaacttcgtctggctcgagctccaccggcggtgccttgagttgcagagcgctggcctgcactgccaccaccgagttcgtgaagaaaaagcgcagcagcgtctctgtacctcggtcccctttccgtccgatcttctcaccggcgtcagacaacgccggtggaataaacaggagaaagggtgtccctcaccgatcgccgctgcactga

SEQ ID NO: 327 - protein, 255 aa, Vitis vinifera
MKMVGFGCDIPHWLEILLGEKFFNACVVHECAKKNEKNIFCLDCCTSICPHCLLPHRHHRLLQIRRYVYHDVIRLDDAQELMDCSLVQSYTTNSAKVVFLNQRPMSRPFRGSGNLCYTCERSLQDPYLFCSLACKVHHTMNVKGSATKHLHNFEFLPLPDRARGEAFSELDDRQMTPESVLDSPVSLRTSSGSSSTGGALSCRALACTATTEFVKKKRSSVSVPRSPFRPIFSPASDNAGGINRRKGVPHRSPLH

SEQ ID NO: 328 - DNA, 753 bp, Vitis vinifera
atggtttcttcaaatcttcttcctagatggcttgaggctcttctcagggagaagttcttcaacgcttgtgtaattcacgagtatgcaaagaagaatgaaaagaacatcttttgcttggactgttgcaccagtatttgccctcactgcttgtcccctcaccgctctcaccgacttttgcagattagaaggtatgtttaccacgatgttataagattggatgatgctgagaaattgatggactgtgcttcagttcaagcttacaccacgaatagtgcaaaagtggtgtttttaaatcaaaggccacagacaaggcaattcagaggctctgggaacatctgcagcacctgtgacaggagtcttcaagacccatatcacttctgctccctctcctgcaagattgactatctcctgagaacagaaggcaagctgtccaagtacctcttcgagtgcgagtacctcacgttgcccgaaccgggttgtgagctcgaggacggtttactcacgcctgactcggtactcgaaccgccaggctcgatgaggacgtcgtcgagttcgagcgccggcgagggtgccggaggagtcggatgccggactctggcttgcactgcgaccaccgagttcgtgaggaagaagcggagtagcgtatcggtgtaccggacagcctgccggccgatatactccccggtttcggagatttcggccggcatgatgaaccggcgaaagggcactccacagcggtcgccgctgtactga

SEQ ID NO: 329 - protein, 250 aa, Vitis vinifera
MVSSNLLPRWLEALLREKFFNACVIHEYAKKNEKNIFCLDCCTSICPHCLSPHRSHRLLQIRRYVYHDVIRLDDAEKLMDCASVQAYTTNSAKVVFLNQRPQTRQFRGSGNICSTCDRSLQDPYHFCSLSCKIDYLLRTEGKLSKYLFECEYLTLPEPGCELEDGLLTPDSVLEPPGSMRTSSSSSAGEGAGGVGCRTLACTATTEFVRKKRSSVSVYRTACRPIYSPVSEISAGMMNRRKGTPQRSPLY

SEQ ID NO: 330 - DNA, 630 bp, Arachis stenosperma
atgatcatgggatacaagcctgcatggttggaagcaccatacagagagaagttctttgtgggatgttcgtaccatgagaaggcgaagaagaacgagaagaacgtgtgctgcttggattgctgcataagtatatgtccacactgcttcccttctcatcgcttccataggcttcttcaggttcgccgttacgtttaccatgacgttgtcagattagaagatcttcagaaactcattgactgctccaatgtccaaccttacaccattaacagcgccaaagttgtcttcatcaagaacaggccccagaaccgccaattcaaatcctccggcaattactgcacttcctgtgaccgtagccttcaagagccttttattcattgctctctttcatgcaaggtggaatttgtgctgaaacactataaggatctatcaccatacttaaggacatgcaagaccctacagctaggtccagacttcttgatcccacaaattcaggagatgggggaggaggagatgacaaccactggaggttcatcatcaacaattgtggacagtgatgagccaatgagttcttgttattcatgggggtccgtcatcaggatcagagaacatgagcatgggttgcagtactga

SEQ ID NO: 331 - protein, 209 aa, Arachis stenosperma
MIMGYKPAWLEAPYREKFFVGCSYHEKAKKNEKNVCCLDCCISICPHCFPSHRFHRLLQVRRYVYHDVVRLEDLQKLIDCSNVQPYTINSAKVVFIKNRPQNRQFKSSGNYCTSCDRSLQEPFIHCSLSCKVEFVLKHYKDLSPYLRTCKTLQLGPDFLIPQIQEMGEEEMTTTGGSSSTIVDSDEPMSSCYSWGSVIRIREHEHGLQY

SEQ ID NO: 332 - DNA, 771 bp, Arabidopsis thaliana
atgggaattcagaaaccggcatggttggatgcgctatacgcagagaagttcttcgtgggatgtccataccatgagacggcgaagaagaacgagaggaacgtgtgttgtcttgattgttgcaccagtctctgccctcactgtgtaccctctcatagattccatagactccttcaagttcgccgttatgtgtatcacgacgttgttcggcttgaagatcttcagaaactcatcgactgctctaacgttcaagcttatacaataaatagtgcaaaagtggtgttcatcaagaagagaccacaaaatagacaattcaaaggagctggcaactattgcacttcttgtgaccgaagtcttcaagaaccttatatccattgctccttgggttgtaaggtggactttgtgatgaaacgttacagggacataaccccattcctcaagccatgccacactctaaccctaggtcctgactacatcatcccacaagacttactgacagatgatgaagtggcggcctacgagactcctcgatcaactgtggtagacggcgatgagtccatgagctggtcctcagcttcctcggataacaacaatgcgggtgcggcggctgcttatgccgcaaccaccacccatgtcgtgaggaaaaaaaggactggtttttgcctttgcgctaaatcggctaatagttataaagaagtttcggaggatcctgacgatatttctgcttgcatcaatcggcgaaaaggcgttcctcaacgatctcctctctgttaa

SEQ ID NO: 333 - protein, 256 aa, Arabidopsis thaliana
MGIQKPAWLDALYAEKFFVGCPYHETAKKNERNVCCLDCCTSLCPHCVPSHRFHRLLQVRRYVYHDVVRLEDLQKLIDCSNVQAYTINSAKVVFIKKRPQNRQFKGAGNYCTSCDRSLQEPYIHCSLGCKVDFVMKRYRDITPFLKPCHTLTLGPDYIIPQDLLTDDEVAAYETPRSTVVDGDESMSWSSASSDNNNAGAAAAYAATTTHVVRKKRTGFCLCAKSANSYKEVSEDPDDISACINRRKGVPQRSPLC

SEQ ID NO: 334 - DNA, 720 bp, Glycine max
atgatcatgggacaccaaaaaccagcatggttggaagctctttacgcacaaaagttctttgtggggtgctctcaccatgagaatgctaaaaaaaacgagaagaacatatgctgcttagattgttgcaccagtatttgccctcactgtttgccatcacatcgctgccataggcttcttcaggttcgccgttacgtttatcatgatgttgtcagattggaagatcttcagaaactcatagattgctctaacgtgcagccttacaccatcaatagtgccaaggtggtgttcatcaagaagagaccacaaaacaggcaactcaaggggtcagcaaactactgcacttcatgtgatagaagtcttcaagaaccttttatccattgctctctaggatgcaaggtggattttgtgctgaaacactacaaggacctctctccctatttgagaacatgcaagtccttgcatctaggtcccgatttcctaatcccacaagagatgggtgatgatgaaacaactcgttcaaccattgtggattttgatgaaccaatgagctcgtcttcagggtcagagaacatgagcatggcttgcaccgaaattgttaggaagaggcgtagtgggtggaatgtgtgtgcaacatcaatgagcaacaaggtttcgcatgaagacatggttacaagcattagtagaaggaaaggcatccctcatagatctcctttgtgttag

SEQ ID NO: 335 - protein, 239 aa, Glycine max
MIMGHQKPAWLEALYAQKFFVGCSHHENAKKNEKNICCLDCCTSICPHCLPSHRCHRLLQVRRYVYHDVVRLEDLQKLIDCSNVQPYTINSAKVVFIKKRPQNRQLKGSANYCTSCDRSLQEPFIHCSLGCKVDFVLKHYKDLSPYLRTCKSLHLGPDFLIPQEMGDDETTRSTIVDFDEPMSSSSGSENMSMACTEIVRKRRSGWNVCATSMSNKVSHEDMVTSISRRKGIPHRSPLC

SEQ ID NO: 336 - DNA, 744 bp, Glycine max
atgatcatgggacaccaaaagcctgcatggttggaagctctttacacacaaaagttcttcgtggggtgctcttaccatgagaacgctaaaaagaatgagaagaatgtcttctgcttagattgttgcaccagtatttgccctcactgcttgccatctcatcgcttccacaggcttcttcaggttcgccgctacgtttatcatgatgttgttaggttggaagatcttcagaaactcattgattgctccaacgttcaggcctataccatcaatagtgccaaagtggtgttcattaagaagagaccccaaaaccggcaattcaaaggatcaggaaactactgcacctcctgtgatagaagtctccaagagccttttatccattgctcccttggatgcaaggtggattttgtgctgaaacactataaggacctctctccctacttgaggacatgcaactcactacagctaagccctgattttctgatcccacaagatatgggggatgaggaaatgactcgttcaaccgttgtggattgtgatgagccaatgagctcatcttctggctcatcagagtcagagaacaacatgagcatgatggcttgcacagagattgttcggaagaggaggagtggatggagcactgtgtgtgcaaaattcatggccaatagcaataaggtttctgatgaagacatggccaccagcatgagtagaagaaaaggcatccctcatagatcccctctgtgttag

SEQ ID NO: 337 - protein, 247 aa, Glycine max
MIMGHQKPAWLEALYTQKFFVGCSYHENAKKNEKNVFCLDCCTSICPHCLPSHRFHRLLQVRRYVYHDVVRLEDLQKLIDCSNVQAYTINSAKVVFIKKRPQNRQFKGSGNYCTSCDRSLQEPFIHCSLGCKVDFVLKHYKDLSPYLRTCNSLQLSPDFLIPQDMGDEEMTRSTVVDCDEPMSSSSGSSESENNMSMMACTEIVRKRRSGWSTVCAKFMANSNKVSDEDMATSMSRRKGIPHRSPLC

SEQ ID NO: 338 - DNA, 747 bp, Glycine max
atgatcatgggataccaaaagcctgcatggttggaagctctttacacacaaaagttcttcgtggggtgctcttaccatgagaacgctaaaaagaatgagaagaatgtctgctgcttagattgctgcaccagtatttgtcctcactgcttgccatctcatcgcttccacaggcttcttcaggttcgccgttacgtttatcatgatgttgttaggttggaagatcttcagaaactcatagattgctccaacgttcaggcctataccatcaatagtgccaaggtggtgttcatcaagaagagacctcaaaaccggcaattcaaaggatcaggaaactactgcacctcctgtgatagaagcctccaagagccttttatccattgctcccttggatgcaaggtggattttgttctgaaacactataaggacctctctccctacttgagaacatgcaactccctacagctaagccctgactttttgatcccacaagatatgggggatgaggaaatgactcgttctaccgttgtggattgtgatgaaccaatgagctcatcttcaggttcatcagggtcagagaataacatgagcatgaacatggcttgcacagagatcgttaggaagaggaggagtggatggagcactgtttgtgcaaaattcatggccaatagcaataaggtttctgatgaagacatggccataagcatgagtagaagaaaaggcatccctcatagatcccctctgtgttag

SEQ ID NO: 339 - protein, 248 aa, Glycine max
MIMGYQKPAWLEALYTQKFFVGCSYHENAKKNEKNVCCLDCCTSICPHCLPSHRFHRLLQVRRYVYHDVVRLEDLQKLIDCSNVQAYTINSAKVVFIKKRPQNRQFKGSGNYCTSCDRSLQEPFIHCSLGCKVDFVLKHYKDLSPYLRTCNSLQLSPDFLIPQDMGDEEMTRSTVVDCDEPMSSSSGSSGSENNMSMNMACTEIVRKRRSGWSTVCAKFMANSNKVSDEDMAISMSRRKGIPHRSPLC

SEQ ID NO: 340 - DNA, 759 bp, Medicago truncatula
atgatcatgggatgccaaaagccttcatggttggaagctctttatacagaaaaattctttgctggttgctcttaccatgagaatgcaaaaaagaatgagaagaatgtttgttgcttagattgttgcactagtatttgtcctcattgctttccatctcatcgctaccaccgccttcttcaagttcgtcgttatgtttatcatgatgttcttagattggaagaacttgagaaacttatagactgcaccaatgtccaggcctatactatcaatagtgccaaagttgtgttcatcaagaagagacctcaaaaccgccaattcaaaggatcaggaaactactgcacttcatgtgatagaatcctccaagaaccttttatccattgctctcttggatgcaaggtggattttgtgctgaaacactacaaagacctttcaccctacttaaggatatgcaacaccctacaattaagtcctgactatctaattccacaagagatgggagatgaattagagatgacaaggtcaacaattgtggattgtgatgatccaatgagttcatattcagtatcatcatcagggtcagagaatatgagtatgccaatgccatgcacagaaattgttaggaagagaaggagtggatggacaagtatgtgtgcaaaattcatggccaattctaatagcaataaagtttctgatgaagatatggctactagtatgattagtagaagaaaaggagttcctcatagatctcctctttgttaa

SEQ ID NO: 341 - protein, 252 aa, Medicago truncatula
MIMGCQKPSWLEALYTEKFFAGCSYHENAKKNEKNVCCLDCCTSICPHCFPSHRYHRLLQVRRYVYHDVLRLEELEKLIDCTNVQAYTINSAKVVFIKKRPQNRQFKGSGNYCTSCDRILQEPFIHCSLGCKVDFVLKHYKDLSPYLRICNTLQLSPDYLIPQEMGDELEMTRSTIVDCDDPMSSYSVSSSGSENMSMPMPCTEIVRKRRSGWTSMCAKFMANSNSNKVSDEDMATSMISRRKGVPHRSPLC

SEQ ID NO: 342 - DNA, 762 bp, Nicotiana tabacum
atgggaattcagaagccagcatggttggaagcaatgtgcacagaaaaattctttgccccatgcccaattcacgagagtgcaaagaagaacgagaagaatatttgttgtttggattgctgcataagtatttgccctcattgtgtgatggctcatcgtttccacagattagttcaaattcgacgttatgtttatcatgatgttgttcgacttgaagacttggagaagctcatagattgctcaaatgtccaggcatacacaataaacagtgctaaggtgatttttatcaagaaaagacctcaaaataggcaattcaaaggatctggaaattattgcacttcttgtgatagaagtcttcaagaaccctttctccattgctctctagggtgcaaggtggattttgtgctaaaacaatacaaggacatttctccattcctaaggagatgcacaactttacaacttagtccagatttctttatccctcaagacatggccgacgacgacacggcccattcgacgattgtggacagcgacgaaccctggggctcgtcgatgtccgactcgtcgggatcggagaacatgatgatgatgatgagtactagtactttcccatgcactgagtttgtgaggaagaagagaagtggattatatgtatgtggaagaacagtagttaatagtaattataagaacttaagtagtgatgaggatatggctactagtatgagtagaagaaaaggcattcctcataggtctcctttgtgttag

SEQ ID NO: 343 - protein, 253 aa, Nicotiana tabacum
MGIQKPAWLEAMCTEKFFAPCPIHESAKKNEKNICCLDCCISICPHCVMAHRFHRLVQIRRYVYHDVVRLEDLEKLIDCSNVQAYTINSAKVIFIKKRPQNRQFKGSGNYCTSCDRSLQEPFLHCSLGCKVDFVLKQYKDISPFLRRCTTLQLSPDFFIPQDMADDDTAHSTIVDSDEPWGSSMSDSSGSENMMMMMSTSTFPCTEFVRKKRSGLYVCGRTVVNSNYKNLSSDEDMATSMSRRKGIPHRSPLC

SEQ ID NO: 344 - DNA, 699 bp, Oryza sativa
atgtggaagccagcatggttagaggccctgaacacacagaagttcttcatagcatgctctttccatgagcatgcgaagaagaatgagaagaacatctgttgccttgactgctgcaccagcatctgcccacactgtgtggcagcacaccgtgtgcacaggctactgcaggtgcggcgctacgtctaccatgatgttgtccggctggaggaccttgagaagctgatcgattgctccagtgttcagtcatacacaattaacagctcaaaggtcgttttcctgaagaaaagaccacagaacaggcaatttaaagggtcagggaatatctgcacctcttgcgatagaagcctccaagaaccctatttccactgctctctggattgcaaggtggaatatatattacggcaaaagaaagacctgtcagcatacttgcgtccatgcaagaccttgcagcttggtccagatttcttcattcctcatgatgctgatgatgagacaacgcactcaacccttgttgatgttgacgagcccatgggatcatcagactcagagaatttgagtgcaccatgcccaaattttgtccgaaagaagcggagtggaccatatatctgtgcacgatctgcaaaccgagtttctgatgatgatatggcaacaaacatgagcagaagaaaaggtgttcctcatagatcacctttgtgctga

SEQ ID NO: 345 - protein, 232 aa, Oryza sativa
MWKPAWLEALNTQKFFIACSFHEHAKKNEKNICCLDCCTSICPHCVAAHRVHRLLQVRRYVYHDVVRLEDLEKLIDCSSVQSYTINSSKVVFLKKRPQNRQFKGSGNICTSCDRSLQEPYFHCSLDCKVEYILRQKKDLSAYLRPCKTLQLGPDFFIPHDADDETTHSTLVDVDEPMGSSDSENLSAPCPNFVRKKRSGPYICARSANRVSDDDMATNMSRRKGVPHRSPLC

SEQ ID NO: 346 - DNA, 732 bp, Populus trichocarpa
atgggaattcaaaagcctgcatggttgggagctctttacacacaaaagttttttgcagggtgctcttatcatgaagctgcaaagaagaatgaaaagaacgtgtgttgtttggattgttgcatcagtatttgccctcactgtataccatcccatcgcttccataggcttcttcaagttcgtcgttatgtttatcatgatgttgtccgattggaagacctcgaaaagctgattgattgctcaaatgttcaggcctataccatcaatagtgcgaaagtggtgtttatcaagaagagagctcagaacaggcaattcaaaggggccggaaactattgtacttcctgtgatagaagccttcaagaaccttttatccattgctctcttggctgcaaggtggactttgtgctgaaacattacaaggacctttctccatacttgaggagatgcaacgcattaactcttggtcctgacttctttatccctcaagatatggcagatgatgagatgaccaatgagacgcctcactcgacaattgtggactccgatgagccgatgagctggtcttcaagttcatcgggttccgaaaacatgagcatcgctagcactgggattgtacggaagaagaggagtggattatacgtatgtgcaagatcattgagcaaggtttctgatgaggacatggcttcaagcatgagtagaagaaaaggcatccctcatcgatctcctctatgttag

SEQ ID NO: 347 - protein, 243 aa, Populus trichocarpa
MGIQKPAWLGALYTQKFFAGCSYHEAAKKNEKNVCCLDCCISICPHCIPSHRFHRLLQVRRYVYHDVVRLEDLEKLIDCSNVQAYTINSAKVVFIKKRAQNRQFKGAGNYCTSCDRSLQEPFIHCSLGCKVDFVLKHYKDLSPYLRRCNALTLGPDFFIPQDMADDEMTNETPHSTIVDSDEPMSWSSSSSGSENMSIASTGIVRKKRSGLYVCARSLSKVSDEDMASSMSRRKGIPHRSPLC

SEQ ID NO: 348 - DNA, 711 bp, Sorghum bicolor
atgatcatggcaatgtggaagccagcatggttagaggcccttaacacacagaagttcttcgtagcatgctctctccatgagcacgccaagaagaacgagaagaacatctgctgccttgactgttgcaccagcatctgcccacactgtgtgggagcacaccgtgtacaccggctcctgcaggtgcggcgatacgtctaccatgatgttgtccggctggaggacctggagaagcttgttgattgctccagtgttcagtcttataccattaacagctctaaggttgttttcctgaagaagagaccacagaataggcaattcaagggatcagggaatatctgcacctcctgcgacaggagccttcaagaaccgtatttccactgctctctggattgcaaggtagaatatatactacggcagaagaaaaatttgtcagcatacttgcgcccatgcaagacgttgcagcttggccctgacttcttcattcctcatgatgctgatgatgacacaactcactcaacccttgttgatgttgatgagcccatgggatcatcggactctgagaatttgagtgcgccatgcacaaattttgttcggaaaaaacggagtggaccatatatttgtgcacggtctgcaaacagagtgtctgatgaagacatggccacaaatatgagcagaaggaaaggggttcctcatagatcgcctttgtgctaa

SEQ ID NO: 349 - protein, 236 aa, Sorghum bicolor
MIMAMWKPAWLEALNTQKFFVACSLHEHAKKNEKNICCLDCCTSICPHCVGAHRVHRLLQVRRYVYHDVVRLEDLEKLVDCSSVQSYTINSSKVVFLKKRPQNRQFKGSGNICTSCDRSLQEPYFHCSLDCKVEYILRQKKNLSAYLRPCKTLQLGPDFFIPHDADDDTTHSTLVDVDEPMGSSDSENLSAPCTNFVRKKRSGPYICARSANRVSDEDMATNMSRRKGVPHRSPLC

SEQ ID NO: 350 - DNA, 714 bp, Triticum aestivum
atgcatcagcaggcaatgtggaagccagcatggttagaggccctcagcacagagaagttcttcgtggcatgctccttccatgagcatgccaagaagaacgagaagaacatatgctgccttgactgctgcaccagcatctgcccacactgtgtgtcgacacaccgggtacaccggctgctgcaggttcggcgatatgtctaccacgacgtcgttcggctggaggaccttgagaagcttattgactgttccggtgttcagtcatacacgattaacagctctaaggtcgttttcctgaagaagagaccacagaataggcaatttaaggggtcagggaatatttgcacctcctgcgacaggagccttcaagagccctatttctactgctctctggattgcaaggttgagtacatattacggaagaagaaagacttgtcagcatacttgcgtccatgcaagaccttgcagcttggtcctgacttcttcattcctcatgacgctgatgatgagacaacccagtcaacacttgttgatgctgatgagcctatgggatcatcagactccgataatttgagcataccatacacaaattttgtccggaagaagcgcagcggaccatatatctgtgcacgatctgcaagccgggtctctgacgatgacatggccacaaacatgagcagaaggaaaggggtgcctcaacgatcacctttgtgctaa

SEQ ID NO: 351 - protein, 237 aa, Triticum aestivum
MHQQAMWKPAWLEALSTEKFFVACSFHEHAKKNEKNICCLDCCTSICPHCVSTHRVHRLLQVRRYVYHDVVRLEDLEKLIDCSGVQSYTINSSKVVFLKKRPQNRQFKGSGNICTSCDRSLQEPYFYCSLDCKVEYILRKKKDLSAYLRPCKTLQLGPDFFIPHDADDETTQSTLVDADEPMGSSDSDNLSIPYTNFVRKKRSGPYICARSASRVSDDDMATNMSRRKGVPQRSPLC

SEQ ID NO: 352 - DNA, 738 bp, Vitis vinifera
atgatcatgggaattcagaaaccagcatggttggaagccctctacacccagaaattcttcgtgagctgctcaattcatgaaactgcaaagaagaatgagaagaatatcctttgtttggattgttgcaccagtatttgccctcattgcttgcagttccatcgcttccataggcttgttcaggttcgtcgttatgtgtatcatgatgttgtcagattggaagacctcgagaagctcatagactgctccaatgttcaggcctatactattaatagcgcaaaagtggtgttcatcaagaaacgacctcagaataggcagtttaaagggtctggaaactattgtacttcctgtgacaggagcctccaagaaccttatatccactgctctcttggctgcaaggtggactttttgctgaaacacaacaaggacctctccccatacttgaggacatgccactctctacaactcagtccagacttcttggtccctccagacatgggagaggatgagatgaccaatgagacaccccactcgacgatcgtggactgcgatgagccaatgagctcgtcttcgggctcttccggttcggagaacatgagcatgatgtgcactgagatagtccgaaagaagcggagtggactgtatgtgtgtggaagatcagctagtaaggtttcagaagaggacatggctacaagcatgagtagaagaaaaggcattcctcatagatctcctatgtgttag

SEQ ID NO: 353 - protein, 245 aa, Vitis vinifera
MIMGIQKPAWLEALYTQKFFVSCSIHETAKKNEKNILCLDCCTSICPHCLQFHRFHRLVQVRRYVYHDVVRLEDLEKLIDCSNVQAYTINSAKVVFIKKRPQNRQFKGSGNYCTSCDRSLQEPYIHCSLGCKVDFLLKHNKDLSPYLRTCHSLQLSPDFLVPPDMGEDEMTNETPHSTIVDCDEPMSSSSGSSGSENMSMMCTEIVRKKRSGLYVCGRSASKVSEEDMATSMSRRKGIPHRSPMC

SEQ ID NO: 354 - DNA, 714 bp, Zea mays
atgatcatgcaggcaatgtggaagccaggatggctagaggcccttgacacacagaagttcttcgtagcatgctctttccatgagcatgccaagaagaacgagaagaacatctgttgccttgactgctgcactagcatctgcccacactgtgtggcagcacaccgtgcacacaggctcctgcaggtgcggcgatacgtctaccatgacgttgtccggctggaggacctggagaagcttattgattgctctagtgttcagtcttatactattaacagctctaaggttgttttcctgaagaagagaccacagaataggcaattcaagggttcagggaatatctgcacctcctgcgacaggagccttcaagaaccgtatttccactgctctctggattgcaaggtagagtatatactacgacagaagaaaaaattgtcagcatatttgcgcccatgcaagaccttgcagcttggccctgatttcttcattcctcatgatgctgatgacgacacaactcactcaacccttgttgatgttgatgagcccatgggatcatcggactcggagaatttgagtgtgccgtgcacaaattttgttcggaaaaaacggagtggaccatatatttgtgcacggtctgcaaacagagtgtctgaagaagacatggccacaaatatgagcagaaggaaaggggttcctcagagatcgcctttgtgctaa

SEQ ID NO: 355 - protein, 237 aa, Zea mays
MIMQAMWKPGWLEALDTQKFFVACSFHEHAKKNEKNICCLDCCTSICPHCVAAHRAHRLLQVRRYVYHDVVRLEDLEKLIDCSSVQSYTINSSKVVFLKKRPQNRQFKGSGNICTSCDRSLQEPYFHCSLDCKVEYILRQKKKLSAYLRPCKTLQLGPDFFIPHDADDDTTHSTLVDVDEPMGSSDSENLSVPCTNFVRKKRSGPYICARSANRVSEEDMATNMSRRKGVPQRSPLC

SEQ ID NO: 356 - DNA, 732 bp, Arabidopsis thaliana
atggttagagaaggtgaagaagaagaagagatgatgatgatgatggcaacgaaacctgcatggcttgaaggtttaatggcggagactttcttctcaagctgtggaatccacgaaactcgccgtaaaagtgaaaagaacgttttttgcttactctgttgtctcagtgtttgtcctcactgtctcccttctcatcgctctcatcctcttcttcaggtgagacgatacgtataccacgacgtcgttcggttgagtgatcttgagaagctcatagattgttcatatgttcagccatatacaattaatggagccaaagtgatattcttaaaccaaagacaacaatcacgagctaaggtttcttcaaatgtttgcttcacttgtgatagaatccttcaagaaccattccacttttgttccctctcttgcaaggtggattatttatcatatcaaggagatgatttatcaagcattctctatagaattgatgaatcagattttacgttcgagggtttgagaatggacggacatgatcagctcggagagatatcgacgatggaggatggggaggatatactggtaatttcagatgaatctgagcaaggtaacaatagtcataagaaagagaagaagaagagcaagaagaagaagccagagagcaattacttgcctgggatggttctttcatcacttggtaatagaagaaaaggtgctcctcatagggctcctttttcataa

SEQ ID NO: 357 - protein, 243 aa, Arabidopsis thaliana
MVREGEEEEEMMMMMATKPAWLEGLMAETFFSSCGIHETRRKSEKNVFCLLCCLSVCPHCLPSHRSHPLLQVRRYVYHDVVRLSDLEKLIDCSYVQPYTINGAKVIFLNQRQQSRAKVSSNVCFTCDRILQEPFHFCSLSCKVDYLSYQGDDLSSILYRIDESDFTFEGLRMDGHDQLGEISTMEDGEDILVISDESEQGNNSHKKEKKKSKKKKPESNYLPGMVLSSLGNRRKGAPHRAPFS

SEQ ID NO: 358 - DNA, 765 bp, Aquilegia sp.
atggtgatgaaaccagcatggctagaaggattaataagtgaaacattctttctagtatgtggggtccatgaaactcgtagaaaaaatggcaagaacatttactgtttgagttgttgtagaagcatttgtccccactgtcttccttctcattgttctcactctctacttcaggtgagacgatatgtttaccaagatgtggtgaggttggacgaaatgaagaagcttattaactgctcttatgttcagtcatatattataaacaatgccaaagtggttttcttgaatcaaaggcctcattcaaggagttataaaagctctccacatagttgtttgacctgtgatagaattctgcaagatccatttcatttctgttgtatatcatgcaaggtcgatcacgtggtgttacaagaggaggacctgtcaagcattttatacaggttcgacgaccaatctgatgactatgcgttttcgcagttcgaggaactacatatggacagttcaaatgcaatggaagaagatgatgatgatgatgatgatcaaatgaccacctctaactattcctctcttggtcatcatcagttcaaggcctcatcttgctctagtgacttgagaagcaacatttctgatgtcatctcacaggagtcacaggttgtcaacaagaagaaaagaagtaaaaagaaaggaggaagtggttttttccctggacttgttctctcattgagtaatagaaggaagggtgcccctcaaagatctcctttactatga

SEQ ID NO: 359 - protein, 254 aa, Aquilegia sp.
MVMKPAWLEGLISETFFLVCGVHETRRKNGKNIYCLSCCRSICPHCLPSHCSHSLLQVRRYVYQDVVRLDEMKKLINCSYVQSYIINNAKVVFLNQRPHSRSYKSSPHSCLTCDRILQDPFHFCCISCKVDHVVLQEEDLSSILYRFDDQSDDYAFSQFEELHMDSSNAMEEDDDDDDDQMTTSNYSSLGHHQFKASSCSSDLRSNISDVISQESQVVNKKKRSKKKGGSGFFPGLVLSLSNRRKGAPQRSPLL

SEQ ID NO: 360 - DNA, 723 bp, Brassica napus
atgatgagagaaggtcatgaggaggaagagatgatgatgatgttgccgaggaaacctgcatggcttgaaggactaatggcggaaactttcttctcgagctgtgggatccacgagagtcgccgtaaaagcgagaagaacgtattttgcttgctctgttgtctcagtgtttgtcctcactgcctcacttcacatcgctctcatcctcttctacaggtgagacgatatgtataccacgatgtcgttcggctgagtgatcttgagaagctcattgattgttcatatattcagccatatacaattaatggagccaaagtgatattcataaaccaaagaccacaatcaagagctaaggtctcttcaaatgtttgcttcacttgtgatagaatcctccaagaaccattccacttttgttcgctctcttgcaaggtggattacttacaatatcaaggagatgatttatcaagcattctctatagaatcgatgaatcggatttcacattttcaagtttgagaatggatggacacgatcagctcggagagatatcaacaatggaggaagataccgacgatattatggtgatgtcagatcagtgggagcagggtaacaatagtaacaagaaggagaaaaggaagacgaaaaaagagagtaattactcgcctgggatggttctttcacttggtagcagaagaaaaggtgctcctcatagggctcctttttcatag

SEQ ID NO: 361 - protein, 240 aa, Brassica napus
MMREGHEEEEMMMMLPRKPAWLEGLMAETFFSSCGIHESRRKSEKNVFCLLCCLSVCPHCLTSHRSHPLLQVRRYVYHDVVRLSDLEKLIDCSYIQPYTINGAKVIFINQRPQSRAKVSSNVCFTCDRILQEPFHFCSLSCKVDYLQYQGDDLSSILYRIDESDFTFSSLRMDGHDQLGEISTMEEDTDDIMVMSDQWEQGNNSNKKEKRKTKKESNYSPGMVLSLGSRRKGAPHRAPFS

SEQ ID NO: 362 - DNA, 702 bp, Glycine max
atgaatatgaatatgaatgagaagcctgcatggctagagaggttgatggctgagacattctttggtgcttgtggggtccaccaggatcgcaggaagaacgagaagaacgtcttttgcttgcactgttgccttagcatctgcccccactgcctctcttcccaccgctctcaccctctcctccaggtgcgaaggtatgtttaccacgacgtgattcgattagatgatctggaaaaactcattgattgttccaatattcagccctatactataaacagcgccaaagtaatattcttaaatcagaggccacaatcaaggacatgcaaaggtcctgccaactcttgcttcacctgtgacaggattcttcaggagccattccatttctgttctctatcatgcaaggttgattacatggtgtacgcgggtcaaagcttgggcagcattttacatcgattcgacgaatctgattttgcaatttcgcagttcgagggtctaagagtggatggctcagaggtaactgaggaagatacccaaattgcccctagttcttcttattccaacactgaggccaccagcaattccgtaatttcatgcgaacctaataacaacgtgaagaagggcaaggccaacaggttcctccctgggatcgtcctgtctcttggcagcagaagaaagggtgcccctcatagggcccctctctcctaa

SEQ ID NO: 363 - protein, 233 aa, Glycine max
MNMNMNEKPAWLERLMAETFFGACGVHQDRRKNEKNVFCLHCCLSICPHCLSSHRSHPLLQVRRYVYHDVIRLDDLEKLIDCSNIQPYTINSAKVIFLNQRPQSRTCKGPANSCFTCDRILQEPFHFCSLSCKVDYMVYAGQSLGSILHRFDESDFAISQFEGLRVDGSEVTEEDTQIAPSSSYSNTEATSNSVISCEPNNNVKKGKANRFLPGIVLSLGSRRKGAPHRAPLS

SEQ ID NO: 364 - DNA, 720 bp, Ipomoea nil
atggtgggtggtggtacaaagcctgcatggatggaagggctaatggcggagacattctttggcggttgcggtgttcaccagcatcgccggaagaacgagaagaacatcttctgcttactttgttgccaaagcttctgccctcactgcctcccttctcatcaatctcatccctttctccaggtgagaagatatgtgtaccaagatgtgataaggttgaatgacttggagaagttgattgactgctcctacattcagccttatacgataaacagtgccaaagtgatattcttgaatcagagggcgcaatcccggtcttgcaagggttccggcaattcttgtttcacttgtgatagaatactgcaagacccctttagcttctgttctctttcctgcaaggttgatttcatggtctaccatgaccaggatttatcaagcattctcttcaagtttgatgaatcagatttcaccttctcccagttcgaggggctacggatggacggatcggattcaccagacgacgaaggccaacacactccgtactcctctctagaggacccgttggagtacaagaatacttcttcctccaacaccgccattgacatttcacgcgattccgagaccaaaaggaacaagaaaggaagtagcggttttctcccaggtttcatggtgtccttgaacaataggagaaagggtgccccttcaaggtctcccctttcttga

SEQ ID NO: 365 - protein, 239 aa, Ipomoea nil
MVGGGTKPAWMEGLMAETFFGGCGVHQHRRKNEKNIFCLLCCQSFCPHCLPSHQSHPFLQVRRYVYQDVIRLNDLEKLIDCSYIQPYTINSAKVIFLNQRAQSRSCKGSGNSCFTCDRILQDPFSFCSLSCKVDFMVYHDQDLSSILFKFDESDFTFSQFEGLRMDGSDSPDDEGQHTPYSSLEDPLEYKNTSSSNTAIDISRDSETKRNKKGSSGFLPGFMVSLNNRRKGAPSRSPLS

SEQ ID NO: 366 - DNA, 726 bp, Oryza sativa
atggggatgaggccgggttgggtaggcgggctggtggaggagagcttcttcgtgggttgcccagcgcacgagagccggaagaagaacgagaagaacatcttctgcctcgcctgctgcaccagcatctgccctcactgcgccccctcccatcgccaccaccctctcctccaggtgcggcggtacgtgtacaatgacgtcgtccgcctcggcgacctcgagaagctcatcgaatgctcctacgtccagccgtacacgatcaacagcgcgaaggtgatattcctgaagccgaggccgcagtcgaggccgttcaaggggtcaggcaatgtgtgcctcacctgcgaccgcatcctgcaggagcccttccacttctgctccctctcctgcaaggtggaccacgtcatggtccacggtggcggcgacctctccaacatcatcctcctccacccccaccaccaccccaacaccgccaccgcctcggccttcccccgtttcgaggacctccgtgtcggcgctgacgatgatgctgccgctatcaccgccgtcacgccagaaggacgttatggtggcggcggtggtgggtctagtgataatggcggcggtgatggcggtggcggcgaggtgggggaggtgaagaggaagaagaagaaggggggagggttcttcccccagattctggggctggggagtaggaggaagggtgcaccccacagatcacccctgtcctaa

SEQ ID NO: 367 - protein, 241 aa, Oryza sativa
MGMRPGWVGGLVEESFFVGCPAHESRKKNEKNIFCLACCTSICPHCAPSHRHHPLLQVRRYVYNDVVRLGDLEKLIECSYVQPYTINSAKVIFLKPRPQSRPFKGSGNVCLTCDRILQEPFHFCSLSCKVDHVMVHGGGDLSNIILLHPHHHPNTATASAFPRFEDLRVGADDDAAAITAVTPEGRYGGGGGGSSDNGGGDGGGGEVGEVKRKKKKGGGFFPQILGLGSRRKGAPHRSPLS

SEQ ID NO: 368 - DNA, 786 bp, Oryza sativa
atggggatgaggcctggatgggtaggggggctcgtggaggagagcttcttcgttgggtgtcccgcccacgagagccgcaagaagaacgagaagaacatcttctgcctcggctgctgcgccagcatctgcccccactgcgccccctcccaccgccaccaccctctcctccaggttaggaggtatgtgtacaacgacgttgttcgcctggatgatctcgacaagctcatcgactgctcctttgttcagccatacacgatcaacagcgcaaaggtgatatttctgaagccaaggcctcagtcgaggccgttcaagggctctggcaacatctgcttgacatgtgacaggatcctgcaggagcccttccatttctgctgcctctcttgcaaggtggatcacgtgatgatgcagggcggcgacctctccaacatcctctacatgtccggcggctcctccggcgagcccgacctcgccgccggcttcccgcgcttcgagaacctccgcgtcgacggcggcggcggcggcggcggcggcctctccgacgacgacgacgaccaccaggtgaccacacccaactccatcctcgaagaccccctccaccaccaccaccaccagtactacggcggcggcggctccagcaacaacggccggagcacgtcgccggcgccaacgacggccgatgtcccgaggaagaagaagagcggcggcggcggcgggttcttcccccagatcgtgctgtcactgaacaacaggaggaagggcgccccacacaggtcgcctctcgcgtga

SEQ ID NO: 369 - protein, 261 aa, Oryza sativa
MGMRPGWVGGLVEESFFVGCPAHESRKKNEKNIFCLGCCASICPHCAPSHRHHPLLQVRRYVYNDVVRLDDLDKLIDCSFVQPYTINSAKVIFLKPRPQSRPFKGSGNICLTCDRILQEPFHFCCLSCKVDHVMMQGGDLSNILYMSGGSSGEPDLAAGFPRFENLRVDGGGGGGGGLSDDDDDHQVTTPNSILEDPLHHHHHQYYGGGGSSNNGRSTSPAPTTADVPRKKKSGGGGGFFPQIVLSLNNRRKGAPHRSPLA

SEQ ID NO: 370 - DNA, 702 bp, Pisum sativum
atggacatagacatgaacatgaacatgaacatgatgaatatgaaacctgcatggctagagaggttgatggatgaaacattcttcggagattgtggggtccacaaaaatcgaaggaagaacgagaagaacattttttgcttacactgttgtcttagcatctgcccccactgcttatcttctcatacctctcatcctcttctccaggtgagaaggtatgtttaccacaatgtaattcgattggatgatctggaaaagctcatagattgttccaatattcagccctatactattaacagtgcgaaagtgatatttttaaaccagaggccacaatcaaggtcatgcaaagttacagccaatgtttgcttcacttgtgacagaattcttcaggatccattccatttctgttctctctcatgcaaggtagaatacatggtgtatgagggtgaaaatttgtcgaacattttacatcgatttgatgaatctgactttgcaatatcgcaattcgagggactaagagtggatggatctgaggtaattgatgaagataacaatcagattgggccaagttcttcaaattactccatcatcaatgaagatcaggccaccagcaacaatagattcctccctctccctctccctgccattgtcctctctcttggtagcagaagaaaaggtgctcctcaaagggccccactctcctaa

SEQ ID NO: 371 - protein, 233 aa, Pisum sativum
MDIDMNMNMNMMNMKPAWLERLMDETFFGDCGVHKNRRKNEKNIFCLHCCLSICPHCLSSHTSHPLLQVRRYVYHNVIRLDDLEKLIDCSNIQPYTINSAKVIFLNQRPQSRSCKVTANVCFTCDRILQDPFHFCSLSCKVEYMVYEGENLSNILHRFDESDFAISQFEGLRVDGSEVIDEDNNQIGPSSSNYSIINEDQATSNNRFLPLPLPAIVLSLGSRRKGAPQRAPLS

SEQ ID NO: 372 - DNA, 810 bp, Populus trichocarpa
atggtgagagagagaaggtacaattataataatagtaatcataataatacatcatcaaggagcagaaatggagttggaggtggtgatgatgatgatgaaatgatgatgatgatgagcagtaagagtatgaagcctgcatggctagaaggattgatggcagagacattcttcggaggttgtggggtccacgagagtcgcagaaagaatgagaagaacgtcttttgcttgctctgttgccttagtatctgccctcactgccttccttctcatcgctctcatcccctcctccaggtgagaagatatgtttaccatgatgttgttcgattgggggatcttgagaagctcattgactgttcttatattcagccctatacaataaacagtgccaaagtgatattcttgaatcagagaccacagtcaagatcctgcaagggttcatccaacaattgcttcacttgcgacaggatactccaagatccattccatttctgctctctctcatgcaaggttaatcacttggtggatcaaggggatgatctctcggctattctttacaggattgatgaatctgattttgcattttcccaatttgagggattgaggatggacggctctgaaattattgatgatgatggtcaaattaccccgagctccatttttgagaacccatcacaacacagaggctcgtcatgctccaatgaaccggaggtcctaggaaagaaggagaaaaaaagtggctttcttccggggaatttcttctctctgagcagcaggagaaagggatctcctcatagggctcctctctcgtaa

SEQ ID NO: 373 - protein, 269 aa, Populus trichocarpa
MVRERRYNYNNSNHNNTSSRSRNGVGGGDDDDEMMMMMSSKSMKPAWLEGLMAETFFGGCGVHESRRKNEKNVFCLLCCLSICPHCLPSHRSHPLLQVRRYVYHDVVRLGDLEKLIDCSYIQPYTINSAKVIFLNQRPQSRSCKGSSNNCFTCDRILQDPFHFCSLSCKVNHLVDQGDDLSAILYRIDESDFAFSQFEGLRMDGSEIIDDDGQITPSSIFENPSQHRGSSCSNEPEVLGKKEKKSGFLPGNFFSLSSRRKGSPHRAPLS

SEQ ID NO: 374 - DNA, 777 bp, Sorghum bicolor
atggggatggcgcccgccgggtgggtggccgggctggtggcggagagcttcttcgtggcgtgccccgcgcacgagtcccgcaagaagaacgagcgcaacatcttctgcctcgcctgctgcgccagcatctgcccgcactgcgcccccgcgcaccgccaccacccgctcctccaggtgcggcgctacgtgtaccatgacgtcgtccgccttggcgacctcgagaagctcatcgactgctcctgtgttcagagctacacgatcaacagtgccaaggtgatcttcctgaagccgaggcctcagtccaggcctttcaagggctccggcaacatctgcctcacatgtgacaggatcctccaggagcccttccacttctgctccctctcttgcaaggtggatcatgtgatgatgcagggaggggacctgtccaacatcctgcagtactatggcggcagcggtgtggcgggggacccggaccgcctcgccttcccgaggttcgagaacctccgcgtcgatggctcggacctcgacgatgacaccgacggtgggcaggtgaccccaaactcgatcctcgaggacccgacgcagcactatggcaatggcggtggcgggggatcaagtgacaatggaggcgacactagggtggatggcggtgcgcggcgcggcggcgaggcggcaaagaggaagaaagggggagggttcttcccccagatcgtgctgtcgcttggcggcggcggtaacaggaggaagggtgccccccacaggtcccctctggcctaa

SEQ ID NO: 375 - protein, 258 aa, Sorghum bicolor
MGMAPAGWVAGLVAESFFVACPAHESRKKNERNIFCLACCASICPHCAPAHRHHPLLQVRRYVYHDVVRLGDLEKLIDCSCVQSYTINSAKVIFLKPRPQSRPFKGSGNICLTCDRILQEPFHFCSLSCKVDHVMMQGGDLSNILQYYGGSGVAGDPDRLAFPRFENLRVDGSDLDDDTDGGQVTPNSILEDPTQHYGNGGGGGSSDNGGDTRVDGGARRGGEAAKRKKGGGFFPQIVLSLGGGGNRRKGAPHRSPLA

SEQ ID NO: 376 - DNA, 744 bp, Sorghum bicolor
atggggatgaggcccgggtgggtaggcgggctggtggaggagagcttcttcgtgggctgcgcggcgcacgagaaccggaagaagaacgagaagaacatcttctgcctcggctgctgcgccagcatctgcccgcactgcgcccccgcgcaccgccaccacctcctcatccaggtgcggaggtacgtgtacaatgacgtggtgcgccttgacgacctcgagaggctcatcgactgctccttcgtccagccctacacgatcaacagtgccaaggtggtcttcctcaagccccggccgcagtccaggcccttcaagggctctggcaacgtctgcttgacctgtgaccgcatcctccaggagccattccacttctgctgcctctcctgcaaggtggaccatgtgatgatgcagggcgggggggacctgtccaacatcctgtacgtgccgggaggcggcggtggcgggccgccggacctggtgggctgcggcttcccgcgcttcgagaacctccgcttcgacgacgacccggcggcgcagtacggcggacaggtcacgcccaactccatcctcgaggaccccatgcagcacggcggcagctccagcggcggctcagccaggaacgctcggcgtggcgacgacgtcccgacgaggaagaagagcggcggcggcggtgggttcttcccccagatcgtcctctcgctcggcaaccggcggaagggcgcgccccatagggcgccgctcgcgtaa

SEQ ID NO: 377 - protein, 247 aa, Sorghum bicolor
MGMRPGWVGGLVEESFFVGCAAHENRKKNEKNIFCLGCCASICPHCAPAHRHHLLIQVRRYVYNDVVRLDDLERLIDCSFVQPYTINSAKVVFLKPRPQSRPFKGSGNVCLTCDRILQEPFHFCCLSCKVDHVMMQGGGDLSNILYVPGGGGGGPPDLVGCGFPRFENLRFDDDPAAQYGGQVTPNSILEDPMQHGGSSSGGSARNARRGDDVPTRKKSGGGGGFFPQIVLSLGNRRKGAPHRAPLA

SEQ ID NO: 378 - DNA, 783 bp, Saccharum officinarum
atggggatggcgcccgccgggtgggtggccgggcttgtggcggagagcttcttcgtggcgtgccccgcgcacgagtcccgcaagaagaacgagcgcaacatcttctgcctcgcctgctgcgccagcatctgcccgcactgcggccccgcgcaccgccaccacccgctcctccaggtgcggcgctacgtgtaccatgacgtcgtccgccttggcgacctcgagaagctcatcgactgctcctgtgttcagacctacacgatcaacagtgccaaggtgatcttcctgaagccgagacctcagtccaggcctttcaagggctccggcaacatctgcctcacatgtgacaggatcctccaggagcccttccacttctgctccctctcttgcaaggtggatcatgtgatgatgcagggaggggacctgtccaacatcctgcagtactacggcggtggtggcacgccggcggacccggaccgcctcgccttcccgaggttcgagaaccttcgcgtcgacggctcggacctcgatgatgacaccgacggtgggcaggtcaccccgaactcgatcctcgaggacccaacggagcactacggcaatagcggtggtggtggcgggggatcaagcgacaatggcagcgacaccagggtcgatggcggtgcgagacgtggtggcgaggcggccaagcggaagaaagggggagggttcttcccccagatcgtgctgtcgctcggcggcggcggcaacaggaggaagggtgccccccacaggtcccctctggcctaa

SEQ ID NO: 379 - protein, 260 aa, Saccharum officinarum
MGMAPAGWVAGLVAESFFVACPAHESRKKNERNIFCLACCASICPHCGPAHRHHPLLQVRRYVYHDVVRLGDLEKLIDCSCVQTYTINSAKVIFLKPRPQSRPFKGSGNICLTCDRILQEPFHFCSLSCKVDHVMMQGGDLSNILQYYGGGGTPADPDRLAFPRFENLRVDGSDLDDDTDGGQVTPNSILEDPTEHYGNSGGGGGGSSDNGSDTRVDGGARRGGEAAKRKKGGGFFPQIVLSLGGGGNRRKGAPHRSPLA

SEQ ID NO: 380 - DNA, 786 bp, Vitis vinifera
atggtgagagaatcatcgtctggcggagggggaggaggcggcggaggtggagttgcaggtggtggtggtggagatatggtaatgaagcctgcatggctggatggtctaatggccgagacattctttgctggttgtggggtccacgagaatcgtaggaagaacgagaagaacgttttttgcttggagtgttgtcaaagcatctgccctcactgtcttccttctcatcgctctcatcctctcctccaggtgaggagatatgtgtaccatgatgtggtcagattggatgaccttgagaagctcattaactgttcttatattcagccttatactataaacagtgccaaagttatattcttgaaccagaggccacagtccaggtcttgtaaaggctctgccaatatttgcttcacttgtgacaggattctccaggagccattccgcttctgttccatttcatgcaaggttgattatatggtgtaccaaggggaagatttgtcgagcattatatacaggtttgacgaatccgatttcgcctactcccaattcgaaggcctacgaatggaggacgaggagggccaaattaccccgaactccatcctggaggacccgttacagttcaaggcctcgtcctgctcctccaacgagacctcgggcaattcaggaatttcacgagatcccgaggcggtggtgaggaagaagaagaaatcaaccggttttctccccggcaattttctctccttgagcagcagaagaaagggtgctcctcataggtctcctctttcttag

SEQ ID NO: 381 - protein, 261 aa, Vitis vinifera
MVRESSSGGGGGGGGGGVAGGGGGDMVMKPAWLDGLMAETFFAGCGVHENRRKNEKNVFCLECCQSICPHCLPSHRSHPLLQVRRYVYHDVVRLDDLEKLINCSYIQPYTINSAKVIFLNQRPQSRSCKGSANICFTCDRILQEPFRFCSISCKVDYMVYQGEDLSSIIYRFDESDFAYSQFEGLRMEDEEGQITPNSILEDPLQFKASSCSSNETSGNSGISRDPEAVVRKKKKSTGFLPGNFLSLSSRRKGAPHRSPLS

SEQ ID NO: 382 - DNA, 750 bp, Zea mays
atggggatgaggcccgggtgggtgggcgggctggtggaggagagcttcttcgtggggtgcgcggcgcacgaggaccggaagaagaacgagaagaacatcttctgcctgggctgctgcgccagcatctgcccgcactgcgcccccgcgcaccgccaccacctcctcctccaggtgcggaggtacgtgtacaatgacgtggtgcgccttgacgacctcgagaggctcatcgactgctccttccagccctacacgatcaacagtgccaaggtgatcttcctcaagccgcggccgcagtccaggcccttcaagggctctggcaacgtctgcttggcctgtgacaggatcctccaggagcccttccacttctgctgcctctcctgcaaggtggaccatgtgatgatgcagggcggggacctgtccaacatcctcctgtacgtgccgggcgggccgccggacctgggctgcggcttcccgcgcttcgagaacctccgcttcgacgacgaccccgggcagtacgggcaggccacgcccagctccatcctcgaagaccccgtcgagcacgggggcagcgccagcgccagcggaggatccagcaacggcggctcggccaggaaccacgcgcggcgcgacgtcgacgtcccgacgaggaagaagaagagcggcgggggcggaggagggttcttccctcagatcgtcctctcgctcggcaacaggcggaagggcgcgccccatagggcgccgctcgcgtaa

SEQ ID NO: 383 - protein, 249 aa, Zea mays
MGMRPGWVGGLVEESFFVGCAAHEDRKKNEKNIFCLGCCASICPHCAPAHRHHLLLQVRRYVYNDVVRLDDLERLIDCSFQPYTINSAKVIFLKPRPQSRPFKGSGNVCLACDRILQEPFHFCCLSCKVDHVMMQGGDLSNILLYVPGGPPDLGCGFPRFENLRFDDDPGQYGQATPSSILEDPVEHGGSASASGGSSNGGSARNHARRDVDVPTRKKKSGGGGGGFFPQIVLSLGNRRKGAPHRAPLA

SEQ ID NO: 384 - DNA, 732 bp, Cryptomeria japonica
atggttggatatcctttgcccgagactccaccaaaaccagcatggttggaggcgctgctgacagatagattttttgttgcttgcccaaggcatcttgagatcaagaaaaacgagaacaatatattttgtgtcgattgcagcaaaagtatctgtcaacactgtctgcccaaccatcagtcacatcgtcttctacaggtgcgaaggtatgtgtaccatgacgttatcaggctgctggacatacagaagttactcgactgttctcaagtgcagacatacataattaatagcgcaaaggtggtattcttgaatcagcggccccagtccagaccagccaaaggcctggcgaactcttgccaaacttgtgacagaagtctggcagagtcgtaccgatattgctctgtctcctgcaaggtagatgctgcattgaacaaagataaaagtttatctcggttgatcaacaattgcagttcattaaccttccctgacatatttacctattctcccagagagggtcctaaacaggtagaagaagaattatcaccgacctctgtgttagaggagacatcatcaggatccacagctaatgacctacgttggatgttaccatgtccgtcaatagacatgcctctgttaaagaaaatatgcagacgtgttgctgcaccagagtctgctccaactaggacatcaggtagcaggagaaagggcattcctcataggtcccccatatactaa

SEQ ID NO: 385 - protein, 243 aa, Cryptomeria japonica
MVGYPLPETPPKPAWLEALLTDRFFVACPRHLEIKKNENNIFCVDCSKSICQHCLPNHQSHRLLQVRRYVYHDVIRLLDIQKLLDCSQVQTYIINSAKVVFLNQRPQSRPAKGLANSCQTCDRSLAESYRYCSVSCKVDAALNKDKSLSRLINNCSSLTFPDIFTYSPREGPKQVEEELSPTSVLEETSSGSTANDLRWMLPCPSIDMPLLKKICRRVAAPESAPTRTSGSRRKGIPHRSPIY

SEQ ID NO: 386 - DNA, 780 bp, Picea glauca
atggttggatatgctctccccgttccacaaaaaccggcatggctgaaggcactgttaacagaccaattctttataccttgctccattcatttggagcacaagaagaatgaagtcaatatcttttgcgtggattgcagtgccagcatttgtcaacactgtcttttttcccatcgctcacatcgccttctgcaggttcgaaggtatgtctaccatgatgttattcggctccaggacatgcagaagttaatagactgttctctggtacagacatatatcaccaacagtgcgagagtggtgttcttaaaccagaggccgcagtctcgactatcgaagggcctggggaattcttgtgaaacctgtgacagggtgctgcaggaaccctaccgttattgctccgtcagatgcaaggtagacgcggtgaaaaatctgtcgagtgtgctgcaatcttgcaattcattgcaactgagggagtttttgtcgccatcgtcatctcctggaagccaaagccccaaggaagaaaaactagagatggaaggaggagaagaaatgtatccagaagagtcactgtcttcaacgtcctctgccagtgacagagacgaatgctggctctcaggcagtggcactgcagcgcccgtcatttacccattgcccaagaaaatgcgcagcagcaacagcaacaggtgtggtggcgggatgatggtgtcttgttcaccaaaatctgtgatcccaccctccatcagcaggagaaagggattccctcacagatcacctctgtattga

SEQ ID NO: 387 - protein, 259 aa, Picea glauca
MVGYALPVPQKPAWLKALLTDQFFIPCSIHLEHKKNEVNIFCVDCSASICQHCLFSHRSHRLLQVRRYVYHDVIRLQDMQKLIDCSLVQTYITNSARVVFLNQRPQSRLSKGLGNSCETCDRVLQEPYRYCSVRCKVDAVKNLSSVLQSCNSLQLREFLSPSSSPGSQSPKEEKLEMEGGEEMYPEESLSSTSSASDRDECWLSGSGTAAPVIYPLPKKMRSSNSNRCGGGMMVSCSPKSVIPPSISRRKGFPHRSPLY

SEQ ID NO: 388 - DNA, 744 bp, Picea glauca
atggtgggatatgctctgtatccctcgctttcaaaaccagcatggttagaggccctgctgacggataaattctttgttgcctgtccgaagcatcttgaattaaagaaaaatgaaagcaacattttttgcatcgattgcagcaaaagtatctgtcaacattgtcttcccaaccatcggtcgcatcggcttcttcaggtgcgaaggtatgtataccacgatgtcattcggcttctagacttgcagaagcttctagattgctcgctagtgcagacatatatcattaatagtgcgaaggtcgtatttttgaaccagcggccccagtccaggcccgccaaaggactgacaaactcttgccaaacttgtgacagaagtctacaggaatcgtactgttattgctcggtttcgtgcaaggtaaatgctgtgttgaataaagaaaaggatttatctacattactgtaccattgcagttcactgccatttcctgatatttttgactactcgagagaaattagttccaaggatggaaaagttgcagagatcgaagaagaattatcggctagcagtacgttggaacagacatgttcaggctccaatgcgaacgatgtgcgttggatgttgacatgttcggaaatagccatgcctttggtaaagaaaatatgcaagcgtcttgcggcaccccactctaatgcccggacatcaactagcaggagaaagggtataccacacagatcgccaatatattaa

SEQ ID NO: 389 - protein, 247 aa, Picea glauca
MVGYALYPSLSKPAWLEALLTDKFFVACPKHLELKKNESNIFCIDCSKSICQHCLPNHRSHRLLQVRRYVYHDVIRLLDLQKLLDCSLVQTYIINSAKVVFLNQRPQSRPAKGLTNSCQTCDRSLQESYCYCSVSCKVNAVLNKEKDLSTLLYHCSSLPFPDIFDYSREISSKDGKVAEIEEELSASSTLEQTCSGSNANDVRWMLTCSEIAMPLVKKICKRLAAPHSNARTSTSRRKGIPHRSPIY

SEQ ID NO: 390 - DNA, 783 bp, Pinus pinaster
atggttggatatgctctctccgttgttccacaaaaaccggcatggctggaggctctgttaacagaccaattctttacaccttgttccattcatttggagcacaagaagaatgaagtcaacatcttttgcgtggattgcagtgccagcatttgtcaacattgcctcttttcccatcgttcccatcgccttctgcaggttcgaaggtacgtctaccatgatgttattcggcttcaggacatgcagaagctaatagactgttctctggtgcagacctatatcaccaacagtgctagagtggtgttcttgaaccagaggccacagtctcgactatcgaagggcctggggaattcttgtgagacctgtgacagggtgctgcaggaaccctaccgttattgctctgtcagatgcaaggtagacgcggtgaaaaatctttcaagtgtgctgcaatcttgcaattcactgcaactgagggagtttttgtcaccatcgtcatctcctacaagccaaagccccaaggatgaaaaactggagatggaaggaggagaagaaatgtacccagaagagtcattgtcttcaacgtcctctgccagtgacagagacgaatgctggctttccggcagcggcacagcagctcacgccgttttcccgttgcctaaaaaattgcgcagcagcaacagcaataggtgtggtggagggatgatggtgtcttgctcaccgaaatctgtgatccccccctccatcagcaggagaaagggattccctcacagatcacctctgtattga

SEQ ID NO: 391 - protein, 260 aa, Pinus pinaster
MVGYALSVVPQKPAWLEALLTDQFFTPCSIHLEHKKNEVNIFCVDCSASICQHCLFSHRSHRLLQVRRYVYHDVIRLQDMQKLIDCSLVQTYITNSARVVFLNQRPQSRLSKGLGNSCETCDRVLQEPYRYCSVRCKVDAVKNLSSVLQSCNSLQLREFLSPSSSPTSQSPKDEKLEMEGGEEMYPEESLSSTSSASDRDECWLSGSGTAAHAVFPLPKKLRSSNSNRCGGGMMVSCSPKSVIPPSISRRKGFPHRSPLY

SEQ ID NO: 392 - DNA, 744 bp, Picea sitchensis
atggtgggatatgctctgtatccctcgctttcaaaaccagcatggttagaggccctgctgactgataaattctttgttgcctgtccgaagcatcttgaattaaagaaaaatgaaagcaacattttttgcatcgattgcagcaaaagtatctgtcaacattgtcttcccaaccatcggtcgcatcggcttcttcaggtgcgaaggtatgtataccacgatgtcattcggcttctagacttacagaagcttctagattgctcgctagtgcagacatatatcattaatagtgcgaaggtcgtatttttgaaccagcggccccagtccaggcccgccaaaggactgacaaactcttgccaaacttgtgacagaagtctacaggaatcgtactgttattgctcggtttcgtgcaaggtaaatgctgtgttgaataaagaaaaggatttatctacattactgtaccattgcagttcactgccatttcctgatatttttgactactcgagagaaattagttccaaggatggaaaagttgcagagatcgaagaagaattatcggctagcagtacgttggaacagacatgttcaggctccaatgcgaacgatgtgcgttggatgatgacatgttcggaaatagccatgcctttggtaaagaaaatatgcaagcgtcttgcggcaccccactctaatgcccggacatcaactagcaggagaaagggtataccacacagatcgccaatatattaa

SEQ ID NO: 393 - protein, 247 aa, Picea sitchensis
MVGYALYPSLSKPAWLEALLTDKFFVACPKHLELKKNESNIFCIDCSKSICQHCLPNHRSHRLLQVRRYVYHDVIRLLDLQKLLDCSLVQTYIINSAKVVFLNQRPQSRPAKGLTNSCQTCDRSLQESYCYCSVSCKVNAVLNKEKDLSTLLYHCSSLPFPDIFDYSREISSKDGKVAEIEEELSASSTLEQTCSGSNANDVRWMMTCSEIAMPLVKKICKRLAAPHSNARTSTSRRKGIPHRSPIY

SEQ ID NO: 394 - DNA, 702 bp, Picea sitchensis
atggtttcatccgatggatccatggatcaaggggcgctgagaggccttaatggtcacgattggctgccagatgcgacggatcaatggcaggtggaacattctctttccgaacgatccggtaaaccggcatggttggaggctctcctgacggacaagttcttcgtcgcttgcccgatgcatgtagacttgaagaaaaacgagaacaacattttctgcatacattgtagcagaagcatttgccatcattgcttgccgacgcaccgttcacatcaccttctgcaggtgcgacggtacgtgtatcacgatgtcatcagattacacgacatgcaaaggctagtcgattgttcctgtgtgcagacatacataatcaacaatgcaagggtcgtatttttgaagcagcgaccgcaatccagaccagccaaaggcttctcaaactattgcaaaacatgcgagagaagcctgcaggaatcttatcgcttctgctgcatagcctgcaaggtagaatccgtattaaatcgacgacaaaatctatcctctctgccacaatcatcatgcaaagctttgccaatttttagtgtcgcctattctttcgggggtcccagggttggtgaggctcaggggaaggagcggttttcatgtggcgattctgtactaaacggccgcccatcgagtcccacccagctcttcctcaacgtcaaatga

SEQ ID NO: 395 - protein, 233 aa, Picea sitchensis
MVSSDGSMDQGALRGLNGHDWLPDATDQWQVEHSLSERSGKPAWLEALLTDKFFVACPMHVDLKKNENNIFCIHCSRSICHHCLPTHRSHHLLQVRRYVYHDVIRLHDMQRLVDCSCVQTYIINNARVVFLKQRPQSRPAKGFSNYCKTCERSLQESYRFCCIACKVESVLNRRQNLSSLPQSSCKALPIFSVAYSFGGPRVGEAQGKERFSCGDSVLNGRPSSPTQLFLNVK

SEQ ID NO: 396 - DNA, 783 bp, Pinus taeda
atggttggatatgctctctccgttgttccacaaaaaccggcatggctggaggctctgttaacggaccaattctttacaccttgttccattcatttggagcacaagaagaatgaagtcaacatcttttgcgtggattgcagtgccagcatttgtcaacattgcctcttttcccatcgttcccatcgccttctgcaggttcgaaggtacgtctaccatgatgttattcggctgcaggacatgcagaagctaatagactgttctctggtgcagacctatatcaccaacagtgctagagtggtgttcttgaaccagaggccacagtctcgactatcgaagggcctggggaattcttgtgagacctgtgacagggtgctgcaggaaccctaccgttattgctctgtcagatgcaaggtagacgcggtgaaaaatctgtcaagtgtgctgcaatcttgcaattcactgcaactgagggagtttttgtcaccatcgtcatctcctacaagccaaagccccaaggatgaaaaactggagatggaaggaggagaagaaatgtacccagaagagtcattgtcttcaacgtcctctgccagtgacagagacgaatgctggctttccggcagcggcacagcagctcacgccattttcccgctgcctaaaaaattgcgcagcagcaacagcaataggtgtggtggagggatgatggtgtcttgctcaccgaaatctgtgatcccaccctccatcagcaggagaaagggattccctcacagatcacctctgtattga

SEQ ID NO: 397 - protein, 260 aa, Pinus taeda
MVGYALSVVPQKPAWLEALLTDQFFTPCSIHLEHKKNEVNIFCVDCSASICQHCLFSHRSHRLLQVRRYVYHDVIRLQDMQKLIDCSLVQTYITNSARVVFLNQRPQSRLSKGLGNSCETCDRVLQEPYRYCSVRCKVDAVKNLSSVLQSCNSLQLREFLSPSSSPTSQSPKDEKLEMEGGEEMYPEESLSSTSSASDRDECWLSGSGTAAHAIFPLPKKLRSSNSNRCGGGMMVSCSPKSVIPPSISRRKGFPHRSPLY

SEQ ID NO: 398 - DNA, 747 bp, Pinus taeda
atggtgggatatgctctgtatccttcgcattcaaaaccagcatggttagaggcactgctgactgataaattctttgttgcctgttcgaaccatctagaattaaggaaaaacgaaagcaacattttttgcatcgattgcagcaaaagtatctgtcaacattgtcttcccaaccatcggtcgcatcggcttcttcaggtgcgaaggtatgtgtaccacgatgttatccggcttctagacttgcagaagcttctagattgctcgctagtgcagacatatatcattaatagtgcgaaggtcgtatttttgaaccagcggccccaatccaggcccgccaaaggactggtaaactcttgccaaacttgtgacagaagtctgcaagaagcgtactgttattgctcggtttcgtgcaaggtaaatgctgtgctgaataaagaaaaggatttatctacattactgtaccattgcagttcgctgccatttcctgatattttttactactccccaagagaaattagttccaaggatggaaagcttgcagagatcggagaagaattatccgctagcagtatgttagaagagacatgttctggctccaatgctaacgatgtgcgttggatgttgacatgttcggaaatagacatgcctttggtaaagaaaatatgcaggcgtgtagctgcgccccactctattgcccggccatcaactagcaggagaaagggtgttccccacagatcaccaatatattaa

SEQ ID NO: 399 - protein, 248 aa, Pinus taeda
MVGYALYPSHSKPAWLEALLTDKFFVACSNHLELRKNESNIFCIDCSKSICQHCLPNHRSHRLLQVRRYVYHDVIRLLDLQKLLDCSLVQTYIINSAKVVFLNQRPQSRPAKGLVNSCQTCDRSLQEAYCYCSVSCKVNAVLNKEKDLSTLLYHCSSLPFPDIFYYSPREISSKDGKLAEIGEELSASSMLEETCSGSNANDVRWMLTCSEIDMPLVKKICRRVAAPHSIARPSTSRRKGVPHRSPIY

SEQ ID NO: 400 - DNA, 741 bp, Welwitschia mirabilis
atggttggaattccgctaacttcttctcctaagaagcctgcctggcttaaggccttgttgtcggatcatttcttcgttccctgtttcaagcatttggacctcaaaaagaatgaagtgaacattttctgcgtggattgctgcgcaagcatatgtcaatactgcctgccgtctcatcgttctcatcgtctcctccaggtacgaaggtatgtttatcatgatgttattaggcttcacgacatccaaaagctgctagattgctcgctggtgcagacgtacatcacgaatagcgcgcgagtggtcttcctcaaccagaggccacagtcacggctatcaaagggtttcgggaattcttgtgaaacctgtgacagggtgttgcaagaaccctaccgttactgctctgtcagatgcaaggtggatgccgtcaagaacttgtcaagcgtcctgctagcgtgcagttccttacagttgacggacttcttgccatcgcctagtagcgcgagcccgaagggcgtcgaggaaacggactacatggaagagtctctttcatcaacatcatctggcgaatttctggctgcagatcgcgctgcaacaccaaatcccaatcaggccactgcgctatttcagttgcctaaaaaaatgcgcagcggaactaggtggagtaatggagtaatgctatgttctcacaagtcggtgattcctagtcggagaaagggctatccccagagatcacctttgtactaa

SEQ ID NO: 401 - protein, 246 aa, Welwitschia mirabilis
MVGIPLTSSPKKPAWLKALLSDHFFVPCFKHLDLKKNEVNIFCVDCCASICQYCLPSHRSHRLLQVRRYVYHDVIRLHDIQKLLDCSLVQTYITNSARVVFLNQRPQSRLSKGFGNSCETCDRVLQEPYRYCSVRCKVDAVKNLSSVLLACSSLQLTDFLPSPSSASPKGVEETDYMEESLSSTSSGEFLAADRAATPNPNQATALFQLPKKMRSGTRWSNGVMLCSHKSVIPSRRKGYPQRSPLY

SEQ ID NO: 402 - DNA, 777 bp, Marchantia polymorpha
atggtgggatacgctctctcaccagcgcagcctcaaaggcctgcctggctcgaggcactcctgaacgagaaatttttcatagcctgcgtaaagcatgccgctctgaaaaagaacgagaggaacattttctgcgtcgactgcagtgacagtatttgccagcactgtctcccagcacaccgaacgcatcggctgttgcagatccggagatacgtctaccatgacgtaattcgcctacaagacattcaaaaactggtcgactgcgcccaagtccagacgtacattatcaacagcgcaagagttgttttcttgaaccgaagacctcagccgcgtccgtcgaagggactcggcaacgcatgcgagacgtgcgtcagaagtctgcaagactcgtaccgatactgctcggtcgcatgcaaggtcgactcgtacatcacccaagataaagacatccacagccttcttccccggtttaccagcctacaatcgtcggatttcttcaattgctcgccatcggagagcctgaaaagcgggaagctcgacatggaggaagacctgtcgccgaattcgactctgagcgatcatccgacgcaaacgtcgtccgattcgtcaggcacggagggagtcgggtgcggaacggtgacctcgacggccaccacgctgccgccgccgaaaaagatcagaagcagcagaccatcggcgctggtatcgtcgcccaagtccgtcatcctgccgtcggtcaaccggagaaagggcacgccccacaggtcgcccctgtggtaa

SEQ ID NO: 403 - protein, 258 aa, Marchantia polymorpha
MVGYALSPAQPQRPAWLEALLNEKFFIACVKHAALKKNERNIFCVDCSDSICQHCLPAHRTHRLLQIRRYVYHDVIRLQDIQKLVDCAQVQTYIINSARVVFLNRRPQPRPSKGLGNACETCVRSLQDSYRYCSVACKVDSYITQDKDIHSLLPRFTSLQSSDFFNCSPSESLKSGKLDMEEDLSPNSTLSDHPTQTSSDSSGTEGVGCGTVTSTATTLPPPKKIRSSRPSALVSSPKSVILPSVNRRKGTPHRSPLW

SEQ ID NO: 404 - DNA, 774 bp, Physcomitrella patens
atggtgggttatgacttgtcggtactgcctcagaaaccagcttggttggagtctctgttggctgaaaagttctttgtgtcgtgcgcaaagcatggggcgttgaagaagaacgagcgaaacgttttctgcgtggactgcaatgctggtgtgtgtcaacattgcgtccctgctcaccagaaccactgcatccttcagattcgtcgatacgtgtatcacgacgtgatccgtctgcaagacatccagcgtcttctggactgtgcaacggttcagacttacatcatcaacagcgcgcgtgtggtgtttctaaaccagaggccgcaaccgcgtccgtcgaaggggttaggaaacgcttgcgggacctgcgacaggagtctccaagactcgtatgcctactgctctgtggcatgcaaagtggacgcagttatcagcaatgggaaggacctctccagcctcttgccagagagcggcaacatgccgtattcgttcttcacgtgttccccgactcggagcttgaaaggtgggaaacacgagttggaggatgaggtactgacggattcgccattcgatatgtcgccgacacatacttcgtcagcttcgacaggcagcgaaggggcggggttctgcggtgttgcctcgacggcttcgactcaattgctgcccaagaaagtccggagcggacgtatttcggcgatagcgacgtcgccgaagtctgtaatatttccggtgtctgtgaagagaaggaaagggacccctcacagatctccattttgttag

SEQ ID NO: 405 - protein, 257 aa, Physcomitrella patens
MVGYDLSVLPQKPAWLESLLAEKFFVSCAKHGALKKNERNVFCVDCNAGVCQHCVPAHQNHCILQIRRYVYHDVIRLQDIQRLLDCATVQTYIINSARVVFLNQRPQPRPSKGLGNACGTCDRSLQDSYAYCSVACKVDAVISNGKDLSSLLPESGNMPYSFFTCSPTRSLKGGKHELEDEVLTDSPFDMSPTHTSSASTGSEGAGFCGVASTASTQLLPKKVRSGRISAIATSPKSVIFPVSVKRRKGTPHRSPFC

SEQ ID NO: 406 - DNA, 774 bp, Physcomitrella patens
atggtgggttatgacctgtcggcgctgcctcagaaaccggcttggttggagtctctcttggccgagaggttctttgtgccgtgtgccaagcacggggcgttcaagaagaacgagagaaatgtgttctgtgtggactgcaatgctggtgtgtgtcagcattgtgttcctgatcaccagaaccattgtattctccagattcgtcgttatgtgtaccacgatgtgatccgtctgcaagatatgcagcgtctcctggactgctcaacggttcagacgtacattatcaatagcgcgcgggtggtgttcctaaatcagaggccgcagccccgtccgtcgaaggggttgggcaacgcttgcggtacttgtgacaggagcctgcaagactcttacgcatactgctcagtggcatgcaaggtggatgccgttgttagcagcgggaaggacctatcaacacttctgcctgagagcggcaacatgccgtactcgttcttcacatgttccccgactcggagcttgaaaggtgggaaacacgagttggaggatgagctattgacggactcactgtgcgacgggtcgccgacgcatacttcgtcagcatcgacaggcagcgaggggataggattctgtggcattgtgtcgacggcttcgactcaattgctgcccaagaaagttcgaagcggacgtatttcgtcgatggcgacgtcgccgaagtctgtaatattcccggtgtctgtgaagagaagaaaagggactcctcacagatctccattttgttag

SEQ ID NO: 407 - protein, 257 aa, Physcomitrella patens
MVGYDLSALPQKPAWLESLLAERFFVPCAKHGAFKKNERNVFCVDCNAGVCQHCVPDHQNHCILQIRRYVYHDVIRLQDMQRLLDCSTVQTYIINSARVVFLNQRPQPRPSKGLGNACGTCDRSLQDSYAYCSVACKVDAVVSSGKDLSTLLPESGNMPYSFFTCSPTRSLKGGKHELEDELLTDSLCDGSPTHTSSASTGSEGIGFCGIVSTASTQLLPKKVRSGRISSMATSPKSVIFPVSVKRRKGTPHRSPFC

SEQ ID NO: 408 - DNA, 783 bp, Selaginella moellendorffii
atggtgggctacgcgctggaatcggcgcctcggaagcccgtctggctcgaggcattgctgagcgagaaattcttcggctgctgctcgacgcacgcgacagtgaaaaagaacgagcggaatatcttctgcgtggattgcaatggcagcatttgccagcactgcctgagcagtcacagcggccatcggctcgtccaggtccggagatatgtgtatcacgatgtgatccggctccacgacatgcaaaaactggtggattgctcgcaagtccagacatacattatcaacagcgcgagagtagtgttcctgaatcaaaggcctcagccaaggccctccaaaggactttcgaattcttgcgacacttgcgagaggagcttgcaagagtcataccgatactgctcaattgcctgcaaggttgatgccgtgggtaacaaccaagtggagttagattctcttgtacctcgtcgggtggcctcctcttcatcgacagatggcggattcagttcctctccggaagatgaaacactcaaggtggacaaactggaactcgacgacgaattgtcgccaaactcggacgattgccagtcgcaggcatcgtcaggctgcagcgggaacaagaacgaggcacagtgcgacgatcacatcgtcacctcggtgatgatgatcccaccaccgaagcggattcgcagcaatcgatatccagggcagtgctcgccaaagtcggtcatcatcccgcattgctccagcaggaggaagagcacaccgcatcggtctccgatcttttag

SEQ ID NO: 409 - protein, 260 aa, Selaginella moellendorffii
MVGYALESAPRKPVWLEALLSEKFFGCCSTHATVKKNERNIFCVDCNGSICQHCLSSHSGHRLVQVRRYVYHDVIRLHDMQKLVDCSQVQTYIINSARVVFLNQRPQPRPSKGLSNSCDTCERSLQESYRYCSIACKVDAVGNNQVELDSLVPRRVASSSSTDGGFSSSPEDETLKVDKLELDDELSPNSDDCQSQASSGCSGNKNEAQCDDHIVTSVMMIPPPKRIRSNRYPGQCSPKSVIIPHCSSRRKSTPHRSPIF

SEQ ID NO: 410 - DNA, 576 bp, Populus trichocarpa
atggtcaatcttagaagtcctagattcctagtcctatatgcatttcagtttcttgtgctggtgcaaatccaagtctcctgttaccagtacaaggttggagatttagatgcttggggtatccctacttcagcaaatccgcaagtgtacacctactggtccaaataccataccttgaagattggggattctctcttgttcttgtatccaccaagtcaagattctgtgattcaagtcacacgagaaaactacaactcctgcaacctgacagatcccatcttgtacatgaacaatggcaactctttatttaacatcactgcatatggggacttctacttcacgagcggagttcaagggcattgtcaaaagaagcagaagctacacatatctgtgcctggcaatggttcagcatcagcatactctccctcttatggtcctagtgcattgcctgactccgcaccctcttaccctaccgtgtttggcagtatcccattaccaccttcttcttcaccattaaacagattttcaatcttgttatcattcattataggagcaggtatttgggcaataatcatgtga

SEQ ID NO: 411 - protein, 191 aa, Populus trichocarpa
MVNLRSPRFLVLYAFQFLVLVQIQVSCYQYKVGDLDAWGIPTSANPQVYTYWSKYHTLKIGDSLLFLYPPSQDSVIQVTRENYNSCNLTDPILYMNNGNSLFNITAYGDFYFTSGVQGHCQKKQKLHISVPGNGSASAYSPSYGPSALPDSAPSYPTVFGSIPLPPSSSPLNRFSILLSFIIGAGIWAIIM

SEQ ID NO: 412 - DNA, 576 bp, Arabidopsis thaliana
atgggagtgatgagtttgagcaagacgatggtggtggtggtattacaggtgatgatattgttgggacaagagattggtaaagtgtcgtcgactctatacaaagttggggacttggacgcttggggcatcccaattgatgctaaagtctattccaaatggcccaaatctcactctttcaagatcggtgactccctcttgttcttgtacccaccaagcgaagactcactgattcaagtgacgccctccaatttcaagagctgcaacaccaaagacccaatcttgtacatgaacgacggcaactctctcttcaacctcacccaaaacggaaccctatacttcacaagtgcaaaccccggccactgtaccaagtaccagaagctcctagtctccgtcggcacctactccgccgaagcagaggccttgtctccgtcttctgccgccgacgctccctcttaccaaaacgccttcgggtccattcctctctctcagaaatcgtctgcttcctcctcgctcatttctgctttctccactgtcgctgcttcgctggcttgcgctgtcgtcggtgcaatcatgtga

SEQ ID NO: 413 - protein, 191 aa, Arabidopsis thaliana
MGVMSLSKTMVVVVLQVMILLGQEIGKVSSTLYKVGDLDAWGIPIDAKVYSKWPKSHSFKIGDSLLFLYPPSEDSLIQVTPSNFKSCNTKDPILYMNDGNSLFNLTQNGTLYFTSANPGHCTKYQKLLVSVGTYSAEAEALSPSSAADAPSYQNAFGSIPLSQKSSASSSLISAFSTVAASLACAVVGAIM

SEQ ID NO: 414 - DNA, 555 bp, Brassica napus
atgggaatgatgagtttgagcagcgtaatggttttggtgatgatactgctagtgcaagtgtcttcgacgcagtacaaagttggggacttggactcatggggtatcccgactgatgctaaagtatactcgaaatggcccaaatctcactctttcaagatcggtgactccctcttgttcttgtacccaccaagcgaagattcaatgattcaagtgacagcttccaacttcaagagctgcaacaccaaagatccgatcttgtacatgaacgacggcaactctctcttcaacctcacccaaaacggaaccttttacttcaccagcggacatcctggccactgtcaaaagtaccagaagctcattgtctccgtcggcacttactccgccgaagcagacgccttgtctccctcctcttcttctgccgatgccgacgctccttcttaccaaaacgcatttggatcgatcccactctctcagaaatcttcgtcttcatcgctgcaattctccaccgtcgttgcttcgctggcctgtgctgtcgtcgtcggtgctctcatgtga

SEQ ID NO: 415 - protein, 184 aa, Brassica napus
MGMMSLSSVMVLVMILLVQVSSTQYKVGDLDSWGIPTDAKVYSKWPKSHSFKIGDSLLFLYPPSEDSMIQVTASNFKSCNTKDPILYMNDGNSLFNLTQNGTFYFTSGHPGHCQKYQKLIVSVGTYSAEADALSPSSSSADADAPSYQNAFGSIPLSQKSSSSSLQFSTVVASLACAVVVGALM

SEQ ID NO: 416 - DNA, 594 bp, Coffea canephora
atggcaagtcttagaatttcaagatgccagttttcgcatgctcttcagttgtatcttttgatccaaaccgccagagtctgctgctaccaatacaaggtcggagatttggatgcttggaacgtaccctcttccgcaaatccagatgtctaccatatatggtccagcaaccacaacttcaccattggagattccctcttgttcctttaccctccaagtcaagattcggtaatacaagtaacagctcaatcctataagagctgcaaccttaaagatccaatcttgacaatgaacgatggcaattcgctcttcaatattacgtcccccggcttgttttacttcaccagtggcgtaccggggcactgtgaaaagtcgcaaaagattcgaattgctgttcctggaaatggatcttacgtatttccaccagatgatgcttcaactgcaccttctccttcttatcctactgttttcggtcccatgccaatgcaggaaacagccccctcttcggcaccattgaccagagttcgtcccatctcaatgtcggctgccactctactcttcctgtgtgtgagtgtgattgccatcggcagcgtttga

SEQ ID NO: 417 - protein, 197 aa, Coffea canephora
MASLRISRCQFSHALQLYLLIQTARVCCYQYKVGDLDAWNVPSSANPDVYHIWSSNHNFTIGDSLLFLYPPSQDSVIQVTAQSYKSCNLKDPILTMNDGNSLFNITSPGLFYFTSGVPGHCEKSQKIRIAVPGNGSYVFPPDDASTAPSPSYPTVFGPMPMQETAPSSAPLTRVRPISMSAATLLFLCVSVIAIGSV

SEQ ID NO: 418 - DNA, 591 bp, Gossypium hirsutum
atggccaatcttagatgtctcacaaaacatttcatatgtgcttgtcagcttctctttttatcgcaagccgaagtcttttgttctcagtacaaggttggagatttagatgcttggggcattccgacatcagcaaatccccaagtatatgccaaatggtccaaaaaccattccttcaagctcggagactctctcttgttcctatacccaccaagtcaagattcagtgatccaagtgacggaacaatcctacaacagttgtgacctcaaagatccaatcttgtacatgaacaatggcaactcactgttcaacatcactaagcctggggagtatttcttcaccagtggggagcctggtcactgtgaaaagaagcagaagctgtacatcgctgtgctttcaggcaacggctctgcagcacttgctccttcttacggtccttctgcattaccggacactgcatcgtcaccgtcttacacgactgtcttcggcaacatccctcaaccgccttcttcatcgccgtcactagggttcccattattcgttacagctgttgttgcatcagccacatggggaataatcaatgccatgatatga

SEQ ID NO: 419 - protein, 196 aa, Gossypium hirsutum
MANLRCLTKHFICACQLLFLSQAEVFCSQYKVGDLDAWGIPTSANPQVYAKWSKNHSFKLGDSLLFLYPPSQDSVIQVTEQSYNSCDLKDPILYMNNGNSLFNITKPGEYFFTSGEPGHCEKKQKLYIAVLSGNGSAALAPSYGPSALPDTASSPSYTTVFGNIPQPPSSSPSLGFPLFVTAVVASATWGIINAMI

SEQ ID NO: 420 - DNA, 591 bp, Malus domestica
atggccaacctcacaactccaagactgcacttccttttggctctgcagttgctcatgttaattcagtcccaagtgctctgctaccagtacaaagtaggagatctagattcttggggaataccaacttctgcaaatccacaggtctacaccaaatggtcaaaataccatcaattcaagcttggagattctcttttgtttttgtacccaccaagccaagactctgtgattcaagtgacagcacaatcctacagcagctgcaacctcaaagatccaatcttgtacatgaacgacggcaactctctcttcaatttcaccacattgggggatttctacttcaccagcggcgaaccgggccattgcgaaaagagccagaagctccacatttcctttctgtctggcaatggctctgctgactctccttcctctggccctagttcattggacgcttctgctccttcttaccccaccgtctttggcaccatcccggctccgccttcttcttcttcttcttctccgtcacaaagatttccagttttcgcagcggccgtcgttggatttgtggtgtttgcacttttcagtggcaatatgtga

SEQ ID NO: 421 - protein, 196 aa, Malus domestica
MANLTTPRLHFLLALQLLMLIQSQVLCYQYKVGDLDSWGIPTSANPQVYTKWSKYHQFKLGDSLLFLYPPSQDSVIQVTAQSYSSCNLKDPILYMNDGNSLFNFTTLGDFYFTSGEPGHCEKSQKLHISFLSGNGSADSPSSGPSSLDASAPSYPTVFGTIPAPPSSSSSSPSQRFPVFAAAVVGFVVFALFSGNM

SEQ ID NO: 422 - DNA, 579 bp, Vitis vinifera
atgggcaatcttagaagttcaagatttcagttcttgtgtgcctttcagtttcttatgctggtgcaaaccagagtgagttgctaccaatacaaggttggagatttggatgcttggggaataccctcctctgcaaatgcacatgtctacaccaactggtccaagaaccacattttcaagattggagattctctcctgttcttatacccaccaagtcaagattcagtgattcaagtcacagggcagtctttcaatgcctgcaaccttacagatccaatcttgtacatgaacaatggtaattccctcttcaacataacctcccttggcgaattctacttcaccagtgcagttccaggtcactgtgaaaagaaacagaagctgcaaatttcagtgctttctggaaatggctcatcagcattctcaccctcttatggtcctagtgctttgcctgattcttcttaccccaccgtctttggctccatccctgccgcaaattcatcttcaccatcacagagggcgcctgtgtttttagcagctgtaatgggatttgtgtcatgggatctgatcagaggcagaatgtga

SEQ ID NO: 423 - protein, 192 aa, Vitis vinifera
MGNLRSSRFQFLCAFQFLMLVQTRVSCYQYKVGDLDAWGIPSSANAHVYTNWSKNHIFKIGDSLLFLYPPSQDSVIQVTGQSFNACNLTDPILYMNNGNSLFNITSLGEFYFTSAVPGHCEKKQKLQISVLSGNGSSAFSPSYGPSALPDSSYPTVFGSIPAANSSSPSQRAPVFLAAVMGFVSWDLIRGRM

SEQ ID NO: 424 - DNA, 594 bp, Glycine max
atggccaatcttagtagtcctggatttaacctctttttggtgtctctcttggttacgttggtccaaatccaaaccaaggtgcaatgctaccagtacaaagttggagatctagattcctgggggatccccatttcaccaagttcacacctctacgacaaatggtccaaatatcacaacctcaggatcggtgattcgcttctgtttctatacccaccaagtcaagattcagtgattcaagtaacagcagaatcctacaagagctgcaaccttaaagatccgattttgtacatgaacaatggcaactccttgttcaacattacatcagagggggacttctacttcacaagtggagaggctggtcattgccaaaagaatcaaaagcttcatataactgtgggagttgggggaaacacgaacgcacttgctccaacttcattgcctgaaaacgcaacctcttacccaactgtgtttggtaacattcccatggctccttctagttctaggagtacttcttcctcacctcaccgaacttcaaaattttccctcttaattattggattcttcctgtgtgccctgctatctagcctaatgtga

SEQ ID NO: 425 - protein, 197 aa, Glycine max
MANLSSPGFNLFLVSLLVTLVQIQTKVQCYQYKVGDLDSWGIPISPSSHLYDKWSKYHNLRIGDSLLFLYPPSQDSVIQVTAESYKSCNLKDPILYMNNGNSLFNITSEGDFYFTSGEAGHCQKNQKLHITVGVGGNTNALAPTSLPENATSYPTVFGNIPMAPSSSRSTSSSPHRTSKFSLLIIGFFLCALLSSLM

SEQ ID NO: 426 - DNA, 396 bp, Glycine max
atggccattttttcaagtcaccacagaatgttggtgtctctcttgcttacgttggtccaaatccaagccaaggtgttttgctatcaatacaaagtgggagatctagatgcttggggcatacccacatcagcaaatccacaagtctacacaaaatggtccaaatatcataatctcacaattggagactcccttttatttctatacccaccaagtcaagattcagtgattcaagttacagaggaatcctacaagaggtgcaacattaaagacccgatattgtacatgaacaatggcaactctttgtttaacattacatcaaagggccaattcttcttcactagtggtgagcctggccattgccaaaaaaaatcaaaagcttcatatatctgttggtga

SEQ ID NO: 427 - protein, 131 aa, Glycine max
MAIFSSHHRMLVSLLLTLVQIQAKVFCYQYKVGDLDAWGIPTSANPQVYTKWSKYHNLTIGDSLLFLYPPSQDSVIQVTEESYKRCNIKDPILYMNNGNSLFNITSKGQFFFTSGEPGHCQKKSKASYICW

SEQ ID NO: 428 - DNA, 522 bp, Tagetes erecta
atgcatgcatatcaataccaagtaggaaatcttcaagcttggaacatacccacatcagaagatccaaatgtttacacaaattggccgaaaaaactcactttcaggatcggtgattcgctattgtttttgtacccaccaagccaagattcagttattcaagtcacaaaacaatcatacaacacttgcaacgttaaagatccaatcttgtacatgaatgatggcaattctttatttaatattacttcacctggtgttttttacttcactagtggtgtttctggtcactgtcaaaaatctcaaaagcttcagatttcggtgtatgcgagtgacgggtcgttaccagagccgcctgcctatggaccgagtggtgcgttggcggactctgcgccttcgtaccagcctgtttttggtgggataccatcaggaccatcaccatcagcagctttgaacattaaggcatcagttttggttactgcagttattggagttttgatttgtggtttagttggtggcaagatatag

SEQ ID NO: 429 - protein, 173 aa, Tagetes erecta
MHAYQYQVGNLQAWNIPTSEDPNVYTNWPKKLTFRIGDSLLFLYPPSQDSVIQVTKQSYNTCNVKDPILYMNDGNSLFNITSPGVFYFTSGVSGHCQKSQKLQISVYASDGSLPEPPAYGPSGALADSAPSYQPVFGGIPSGPSPSAALNIKASVLVTAVIGVLICGLVGGKI

SEQ ID NO: 430 - DNA, 603 bp, Solanum lycopersicum
atggctactcttagaaatccaagaaaataccaatctttgatcattctttttcagttctttctgttaatacaaatccaattagtgttctgttatcaatacaaagttggagatttaaatgcttggaatataccctcttctgcaaataaagatgtctatctcaaatggtccaagaatcacatcttcaagcttggagattcaatcttgtttttgtacccaccaagtgaagattcagtaatacaggtaacaaaacagaattacaacagttgcaaccttaaaaatccaatcttgtacatgaacaatgggaattctctgtttaacattacaagacctggagagttttacttcacaagtggagcagaagggcattgtgagaagttgcagaaacttcatatttcaattggaggaggaaatggaacaagttatgatgaagcagattcacctgcttttgctccatcaccttcttacactaatgtttttggttcaattcctgtccaatcttctaattcaacctctgcttcgtcttctgggaaagttgaaatctctgtttttgctgctgttggattgctctttcttactctgtttataggaagcactattctttag

SEQ ID NO: 431 - protein, 200 aa, Solanum lycopersicum
MATLRNPRKYQSLIILFQFFLLIQIQLVFCYQYKVGDLNAWNIPSSANKDVYLKWSKNHIFKLGDSILFLYPPSEDSVIQVTKQNYNSCNLKNPILYMNNGNSLFNITRPGEFYFTSGAEGHCEKLQKLHISIGGGNGTSYDEADSPAFAPSPSYTNVFGSIPVQSSNSTSASSSGKVEISVFAAVGLLFLTLFIGSTIL

SEQ ID NO: 432 - DNA, 558 bp, Triphysaria sp.
atgggctgtcttaaaaaattttacactcttattcttcttttgtccattcaaggcaaaaccttgtgctccatttacaaagttggagatttagattcttggggcattcccacttcaaatccacaactctacacaaaatggtccaaaactcacaatctcaagattggagattctctttttttcttatacctaccaagccaagattcagtgatccaggtgacaggagaagggtacaaagaatgcaacataaaagatccaattttgtacatgaataatggcaattcattattcaatattagcagggcaggggattattacttcactagtggagctgagggccattgtgcaaaatcacaaaaactttacatttctgtgaatggaaatggatcgtctactgctgaagactcacctgctgcatatggtccgtctgcatctgcgccgtcttattccaacgtcttcggctcgattccgatacaggcttctgcttcatcaatgatgaagatcccggttttcttgactgtggcagctgctgggatttttatatatctgattggggtataa

SEQ ID NO: 433 - protein, 185 aa, Triphysaria sp.
MGCLKKFYTLILLLSIQGKTLCSIYKVGDLDSWGIPTSNPQLYTKWSKTHNLKIGDSLFFLYLPSQDSVIQVTGEGYKECNIKDPILYMNNGNSLFNISRAGDYYFTSGAEGHCAKSQKLYISVNGNGSSTAEDSPAAYGPSASAPSYSNVFGSIPIQASASSMMKIPVFLTVAAAGIFIYLIGV

SEQ ID NO: 434 - DNA, 735 bp, Hordeum vulgare
atgggcatgccgacgacgcttctgcttcttgcggcgctgctgctcctcctcatgtccatgtccatgtccggctgctccgcggcggcgacgtacaaggttggcgggctggacgcgtggggggcgccgccctccacaaagccggacgtctacatccgctgggccaagtccgtccccgtcaagctcggcgacgccgtcttcttcctctacccgcccagccaggacagcgccgtccaggtcaccgccaaggccttcgccgcctgcgacgtctccgacccgctgctcaagctccacgacggcaactccctcttcaacctcaccaagccgggacgggtctacttcaccagcgacgcccccggacgctgccgcaagggccagaagctctcgctcgacgtgcccgccgccgacgggaagctgctcaagccgtccgccgacgacgaggcggctctcaaggcgcttgcgtcgctgccgcctgccgctgcccccacggaggcgctgccatcgctctcccccgacgacgacgacgactccggctccgtgccccggcgaggccggatcatagttctcgttggcgacctgtctctcggcgttgctttatgctgtgagatgagatggaacttttcttgtcatcaaatcaatcaatccattttaattttaattttgggtttgggcacaggaggaaaggaaaaagaaatttttcttcaaaaaaagaaactgaaaaacaaaaaaaaaaaataa

SEQ ID NO: 435 - protein, 244 aa, Hordeum vulgare
MGMPTTLLLLAALLLLLMSMSMSGCSAAATYKVGGLDAWGAPPSTKPDVYIRWAKSVPVKLGDAVFFLYPPSQDSAVQVTAKAFAACDVSDPLLKLHDGNSLFNLTKPGRVYFTSDAPGRCRKGQKLSLDVPAADGKLLKPSADDEAALKALASLPPAAAPTEALPSLSPDDDDDSGSVPRRGRIIVLVGDLSLGVALCCEMRWNFSCHQINQSILILILGLGTGGKEKEIFLQKKKLKNKKKK

SEQ ID NO: 436 - DNA, 597 bp, Oryza sativa
atgcgtggggcgtcggcattggcatctctcgtcgccgcggcggcggtggcgctgctcctcctcatcgacggctgcggcggcgccatgtacaaggttggcgacctcgacgcctggggcatcccgccgccgtccaagcccgacgtctactcgcgctgggccaaatccatccacttcgcgctcggcgactccatctggtttctgtacccgccgagccaggactcggtggtgcaggtgacgccggtggcgttcgccgcctgccaggcgtcggacccggtgctgaagctcgacgacggcaactccgtcttcaacctcaccacgcccggccgcgtctactacatcagcgccgcgctgggacactgccggaagggccagaggctggccgtcgacgtgcccatggccaacggcacctacctgccgcccaccgccaacgacctcgccgccttcgcgccgatgccggccgaggcgccggcggggttcgagtcggcggcgctcggccccgccggagcgcgacagtcggcggcgccccgagccgccgccgccggcggagctggatccgtccttcttgctgctcttgccttcgccgtcttcttgctgtga

SEQ ID NO: 437 - protein, 198 aa, Oryza sativa
MRGASALASLVAAAAVALLLLIDGCGGAMYKVGDLDAWGIPPPSKPDVYSRWAKSIHFALGDSIWFLYPPSQDSVVQVTPVAFAACQASDPVLKLDDGNSVFNLTTPGRVYYISAALGHCRKGQRLAVDVPMANGTYLPPTANDLAAFAPMPAEAPAGFESAALGPAGARQSAAPRAAAAGGAGSVLLAALAFAVFLL

SEQ ID NO: 438 - DNA, 609 bp, Zea mays
atgaggatgcgtgcgcgggcggcatcggcatccgcgtcggcggctgtggtggtgctgctcctgctcctgctactggtgggcgtctgcgtgggcgccgtgtacaaggtaggcgacctggacgcctggggcgtgccgccgccgtccaagcccgacgtctacaagcgctgggccaagtccatccacttcgcgctcggcgactccatctggttcctgtacccgccgagccaggactcggtgctgcagctggcgccggcggccttcgcgtcctgcgacctgtcgcgccctgtggccaggctcgccgacggcaactcattattcaacctcaccgcgcccggccgcgcctactacgccagcggcgcgccgggccactgccgcaggggccagaagctctgggtcgatgtgcccttgcccaacggcacctacctccagccctccgccaccgacctcgccgcgctcgcgcccacccccgccgccgacccgcccgccgggttcgcgtccgctgccgccgccgcgccacaggggggcaacgcctcgcccgcgccccgcgccgccgccgccgctggatccgtcgtcgcactctccttcgcgctccagatcctcctcctctga

SEQ ID NO: 439 - protein, 202 aa, Zea mays
MRMRARAASASASAAVVVLLLLLLLVGVCVGAVYKVGDLDAWGVPPPSKPDVYKRWAKSIHFALGDSIWFLYPPSQDSVLQLAPAAFASCDLSRPVARLADGNSLFNLTAPGRAYYASGAPGHCRRGQKLWVDVPLPNGTYLQPSATDLAALAPTPAADPPAGFASAAAAAPQGGNASPAPRAAAAAGSVVALSFALQILLL

SEQ ID NO: 440 - DNA, 576 bp, Picea glauca
cttcaagagaaatgtcaactgtggaggagatcaaccaatatttttataatgaatgaatgaatgaatgccacaaaatgtttacactggatctagaagagaagcgcatatagtccaaatgctagaccaaccataaagccaagaggacctgcagattgcatggtaggagcactactagtcggtttgacactattagccggacttcccgccccaggggcaagggcaggagcagaagcagaagcagaatctggaggaggaaaagcaccattggcacccaatacaagaactgctagcttctgggatttttcacagtgcccgggcacaccactagtgaagtagtatgaaccccactgactgaatttgaaagctgtgttcccatcctgaaatgatgttattggacttgatatatcacacctgctatatgcttccttagtgacttgaatcactgaatcctgacttggtgggtacaagaacaagagagaatccccaactttgaatgtgttgttggaaacccattgctggtatagatcctttctgccaccagtggggatggcccatgcatccaatgcccccactttg

SEQ ID NO: 441 - protein, 191 aa, Picea glauca
MRMWLGLWLGIGFLMVSLQGSSAVASAYEFKVGALDAWAIPTGGRKDLYQQWVSNNTFKVGDSLLFLYPPSQDSVIQVTKEAYSRCDISSPITSFQDGNTAFKFSQWGSYYFTSGVPGHCEKSQKLAVLVLGANGAFPPPDSASASAPALAPGAGSPANSVKPTSSAPTMQSAGPLGFMVGLAFGLYALLF

SEQ ID NO: 442 - DNA, 567 bp, Arabidopsis thaliana
atggattcatcaaagaagatcattatcgttatgtttcttgtaacattttacatgttttcatgtgtttcaagcactgaatttgaagttggaggagaaaatggttggatcgtaccaaaatctaagactcttggagatgcgtttaaccaatgggcgtcagataaccggtttaaagttggtgacactctccgtttcaagtacacgaaagactcagtgttagtggtgtcagaagaagagtacaagaaatgcaaagcgaccaaaccacaactctactcaaacaacgaagacactgttttcaaactagaccgacccggtttgttttacttcatcagcggtgtctctggccactgcgaaaagggtcagaagatgatcgtaaaagttatggagacggagtcttctacagagtctcctcctccatcctcttcttcttcttcttcgtcatcatcatctcttccggcgtcaactcccaaggccaagaagagcaatgccttcaaaaccgcagtccagttcagtagttccggttttgttgtctctgctgttctgattgtttcagtttttggtttggtttag

SEQ ID NO: 443 - protein, 188 aa, Arabidopsis thaliana
MDSSKKIIIVMFLVTFYMFSCVSSTEFEVGGENGWIVPKSKTLGDAFNQWASDNRFKVGDTLRFKYTKDSVLVVSEEEYKKCKATKPQLYSNNEDTVFKLDRPGLFYFISGVSGHCEKGQKMIVKVMETESSTESPPPSSSSSSSSSSSLPASTPKAKKSNAFKTAVQFSSSGFVVSAVLIVSVFGLV

SEQ ID NO: 444 - DNA, 501 bp, Nicotiana tabacum
atggattcctctaaagcttttctttacttagtgttcttcctcttttcacttcatttctttacggtttttgccactgaatttgctgttggcggtgacaaaggatgggctgttcctaaagtaaaagatgatcaagtgtatgaccagtgggctggaaaaaataggtttaagattggcgacaccttaagttttgagtataagaaagattcggttctggtggtgaccaaagaagagtacgagaaatgcaagtcgagtcatccaattttcttctctaacaatggaaaaaccatctataaattggagcaaccagggttgtactacttcattagtggagtatcaggacattgcgagaggggtttgaaaatgataatcaaagttttagaaccagaatccccacctcaatctgctaaccagacttccccaactagtagtggtactactgcagctgctactccaactacaatggcgtttgtggtgtcattatttggagctcttctttattaa

SEQ ID NO: 445 - protein, 166 aa, Nicotiana tabacum
MDSSKAFLYLVFFLFSLHFFTVFATEFAVGGDKGWAVPKVKDDQVYDQWAGKNRFKIGDTLSFEYKKDSVLVVTKEEYEKCKSSHPIFFSNNGKTIYKLEQPGLYYFISGVSGHCERGLKMIIKVLEPESPPQSANQTSPTSSGTTAAATPTTMAFVVSLFGALLY

SEQ ID NO: 446 - DNA, 489 bp, Glycine max
atggctattccctacaaagcctcaagcccacttttcctttgcttgattctttcatgtggtgactcccttgtcaattgctctgagtttgaagttggaggtcacgatggttgggttgttccaaagccaaaggacgatgatcaaatgtacaatcagtgggcatcccaaaacagattcaaagttaatgacactcttctgttcaagtacgagagagactcggttatggtggtgacggaagaagagtatgaaaaatgcaaagcctctcgtcccctctttttctctaacaatggtgacacagtcttcaagtttgaccggccaggcttgttctacttcattagtggggtgagtggtcactgtgacagagggcagcggatgatcatcaaggttttggatgtggagccagcagcacccccacctcaatctgcaaatgaggatgcacaaaaaccaccacataaaaaaaatggagttgctgaaatgattcctatgaattga

SEQ ID NO: 447 - protein, 162 aa, Glycine max
MAIPYKASSPLFLCLILSCGDSLVNCSEFEVGGHDGWVVPKPKDDDQMYNQWASQNRFKVNDTLLFKYERDSVMVVTEEEYEKCKASRPLFFSNNGDTVFKFDRPGLFYFISGVSGHCDRGQRMIIKVLDVEPAAPPPQSANEDAQKPPHKKNGVAEMIPMN

SEQ ID NO: 448 - DNA, 504 bp, Nicotiana tabacum
atggccttcttatgctctagtaacatgctcttctcaattttaatgatgatttctcttcatcaagtcgtgtatgtctcctccttggaatttcaagttggtgacactactggttgggcagttcctccctcaaatgacaccaatttttacaacaattgggcttccaatatgaggttcaaaatcggcgacaccattcgtttcaagtacaagaaggactcagtaatggaggtgacagagaatgaatacaagaaatgcaactcgactcgcccccatttcttttccaacaatggaaacacgatgttcacgttggatcgttcaggctatttttatttcgtgagcggagcagcaggacattgtgagagaggcgagcgtatgatcgttagggttctggttcaggatgtgatcaatgattattctgctgcagcatcagctccagcattggcactctttcaacaactttatgctcttccgtttgtgttcttttttttcgtttcacttctctactag

SEQ ID NO: 449 - protein, 167 aa, Nicotiana tabacum
MAFLCSSNMLFSILMMISLHQVVYVSSLEFQVGDTTGWAVPPSNDTNFYNNWASNMRFKIGDTIRFKYKKDSVMEVTENEYKKCNSTRPHFFSNNGNTMFTLDRSGYFYFVSGAAGHCERGERMIVRVLVQDVINDYSAAASAPALALFQQLYALPFVFFFFVSLLY

SEQ ID NO: 450 - DNA, 525 bp, Vitis vinifera
atggcttcttctcccttgatgggttccaccacagtgcttgtgcttttactcaccatcttctcttctctccaacgctccaccgtctcctcctttgagttccaagcgggggaggtcaaggggtgggtcgtccctcatgcaaacgacagcaaactctacaatgactgggcctctgagaacaggttcaaggtcggcgactccatccgctttaggtacaagaaagattcagtgatggtggtgagtgaggcagactacaagaaatgcaattccacgcaccccatcttcttctccaacactggcaacacagtctaccacttggaccactctggatcttactacttcatcagtggggtggctgaacactgccagagaggacagaggatgatcgtaaaagtgatggcatcagaggacccatctagtaggggtggtggcactcctccttccagtgctccaactctctcacttggaccctctaaactagtgtttttccagtttcttttatcatctgtggctgcttatctcttctag

SEQ ID NO: 451 - protein, 174 aa, Vitis vinifera
MASSPLMGSTTVLVLLLTIFSSLQRSTVSSFEFQAGEVKGWVVPHANDSKLYNDWASENRFKVGDSIRFRYKKDSVMVVSEADYKKCNSTHPIFFSNTGNTVYHLDHSGSYYFISGVAEHCQRGQRMIVKVMASEDPSSRGGGTPPSSAPTLSLGPSKLVFFQFLLSSVAAYLF

SEQ ID NO: 452 - DNA, 579 bp, Arabidopsis thaliana
atgatgatgatgatgatgagatctacttgtaatctaacactaatgctctgcatttgtgcccttgtggtggcttccatggcggcggaaggtcctagggatttcaaggttggagacgagttcgggtggagagtcccactccagaatgattcagcggtttacagccactgggccagcagcaaccgcttccacatcggtgattcactctcgtttgtgtacgacaaggactcggtgatggaggtagacaaatggggtttctaccactgcaacggcagcgatcccattacagcctttgacaatggaaacagcacattcgaccttgatcgtcctggtctcttctacttcatcagcggctccaaccagcactgcaccagcggccagcgtctcatcgtagaagtcatgcatatccaccaacaccatgaccatgacgcttccatgcctccatccatgtcgcctctttctaattctgcctctccctacgcatccgcatccgcatcttctgctgcctcctccctgcctacggcttgtcttcttattcctcttttcttaaccattgctagctttcgtttcatttcttattag

SEQ ID NO: 453 - protein, 192 aa, Arabidopsis thaliana
MMMMMMRSTCNLTLMLCICALVVASMAAEGPRDFKVGDEFGWRVPLQNDSAVYSHWASSNRFHIGDSLSFVYDKDSVMEVDKWGFYHCNGSDPITAFDNGNSTFDLDRPGLFYFISGSNQHCTSGQRLIVEVMHIHQHHDHDASMPPSMSPLSNSASPYASASASSAASSLPTACLLIPLFLTIASFRFISY

SEQ ID NO: 454 - DNA, 627 bp, Lactuca virosa
atggcttccgattccgcttattctttcgcttcccatacagttttgcatcttttctggttctttctccttgcagtcgccgccgtcactaccaccgtcggcgctatcgaattcccagttggtggcgacgttggttggcgaatccctgcaaccaacgaaaccgaactctacactgtctgggcttccagacgaaacttccatatcggcgataccctccgttttcgttacaagaatgattcagtggccgtggttaaaaaatgggggttctaccactgtaattctagctctccgatagcattcttcaacgacggcgactccgtgatcaatcttgataatgtgggaacgatgtatatcatcagcggcgactctgatcggtgtaaagaaggtgagaagatgaagttggaggtgatgggttctgaccctggttcttacttcccgccgtcgatttctagtccgccggagagcccttattccgacatagctccgtcgccatctcagttctccggttatggtggttcgcccgcatttagtccgcgttattcttcgtcaagctccgcgatatcgttttcaatttctttgtttgtgattgctttgatcgttggtttaggactgattttgttatccatttag

SEQ ID NO: 455 - protein, 208 aa, Lactuca virosa
MASDSAYSFASHTVLHLFWFFLLAVAAVTTTVGAIEFPVGGDVGWRIPATNETELYTVWASRRNFHIGDTLRFRYKNDSVAVVKKWGFYHCNSSSPIAFFNDGDSVINLDNVGTMYIISGDSDRCKEGEKMKLEVMGSDPGSYFPPSISSPPESPYSDIAPSPSQFSGYGGSPAFSPRYSSSSSAISFSISLFVIALIVGLGLILLSI

SEQ ID NO: 456 - DNA, 624 bp, Arabidopsis thaliana
atggtgtctttgattagcattgtgtccgtagtgtttcttttatttacaacattctaccactttggtgaggctagaatcattaatgtgggaggatcattagacgcatggaaggttccagaatctcccaaccactctctcaaccattgggctgagtccgtccggttccaagtcggagacgctcttttgtttaaatacgattcaaagatcgattcggtgttacaagtaacaaaagaaaactacgaaaaatgcaacacacagaagcctttggaagaacacaaagacggatacacaacagtgaaactcgacgtctcagggccttactacttcataagtggagctccgagtggtaactgtgctaaaggtgagaaagtgactgtcgtggttcagtcacctaaccacccaaagccaggaccagccgctgttacgcccactcttcctccaaagccatctactactccggctgctccagccccagctccacccactccttctccaaagtcatctacttctacgatggctccggcgccagctccggccaagagcagtgctgttgggttggttgctggaaatggcatcttttgggcctcgactcttgttgctgtcattgggcttgctttcgcttaa

SEQ ID NO: 457 - protein, 207 aa, Arabidopsis thaliana
MVSLISIVSVVFLLFTTFYHFGEARIINVGGSLDAWKVPESPNHSLNHWAESVRFQVGDALLFKYDSKIDSVLQVTKENYEKCNTQKPLEEHKDGYTTVKLDVSGPYYFISGAPSGNCAKGEKVTVVVQSPNHPKPGPAAVTPTLPPKPSTTPAAPAPAPPTPSPKSSTSTMAPAPAPAKSSAVGLVAGNGIFWASTLVAVIGLAFA

SEQ ID NO: 458 - DNA, 549 bp, Arabidopsis thaliana
atgtttctatcggcatctatggcttcttcttcacttcacgttgctatcttctctttaatcttcttattctcactcgccgctgcaaatgaagtcaccgtcggtggaaaatccggcgactggaagatccctccttcctcttcttactcattcactgagtgggctcaaaaagctcgcttcaaagtcggcgactttattgttttccggtatgaatctggtaaagactctgttttggaagtaacaaaagaagcttacaacagctgcaacaccacgaaccctttggctaactacactgatggagaaaccaaggtgaaattggacaggtctggtcctttctacttcattagtggagctaatggtcactgtgagaaaggtcagaagctgagccttgttgtgatcagtcctcgtcacagtgtcatctctccagctccttctccggttgaattcgaagatggtccagctttggctccagctcccattagcggctcagttaggcttggtggttgttatgttgtgttaggtcttgttcttggtctatgtgcttggttctga

SEQ ID NO: 459 - protein, 182 aa, Arabidopsis thaliana
MFLSASMASSSLHVAIFSLIFLFSLAAANEVTVGGKSGDWKIPPSSSYSFTEWAQKARFKVGDFIVFRYESGKDSVLEVTKEAYNSCNTTNPLANYTDGETKVKLDRSGPFYFISGANGHCEKGQKLSLVVISPRHSVISPAPSPVEFEDGPALAPAPISGSVRLGGCYVVLGLVLGLCAWF

SEQ ID NO: 460 - DNA, 534 bp, Arabidopsis thaliana
atggcttcttcttctcttttggtcaccatcttcctctgcatctctgtcttcttcttttcgtccgtgaatgcaaatgaggttaccgtcggtggaaaatccggtgactggaagatccctccttcctcttctttctcctttaacgaatgggctcaaaaggctcgcttcaaagtcggcgactttatcgtattcaagtacgaagccggtaaagactcggttttgcaagtgacacgagaagcatacgagaaatgcaacaccactagccctaaagccagctacaccgacgggaacacaaaggtgaagcttgaccaagctggtccggtctacttcgtcagtggaacagagggtcattgtcaaaagggtcagaagctacgcctagtcgtcatcactcctcgtaactctgctttctctccaggtccttcgccatctgagttcgacggtccagccgtagctcctactagtggtgccgctaagctcgccggcggatttagtgtcgtatttgggcttgttcttggattatgggccttcttcttttaa

SEQ ID NO: 461 - protein, 177 aa, Arabidopsis thaliana
MASSSLLVTIFLCISVFFFSSVNANEVTVGGKSGDWKIPPSSSFSFNEWAQKARFKVGDFIVFKYEAGKDSVLQVTREAYEKCNTTSPKASYTDGNTKVKLDQAGPVYFVSGTEGHCQKGQKLRLVVITPRNSAFSPGPSPSEFDGPAVAPTSGAAKLAGGFSVVFGLVLGLWAFFF

SEQ ID NO: 462 - DNA, 537 bp, Cucumis sativus
atggctaatttttcaatagctctgtctctcttcacctttctcctcctcttcatcagcttctcagaggctagagagattttagtcggaggcaaatccaatgcctggaaaatcccttcttctcaatctcaatctctcaatcaatgggctgaaacctctcgctttcgcattggcgacactctcgtgtgggattacgaagatgggaaagattcggtactgaaagtgacgaaggaagattatgaagcctgcaataccgaaaaccctgaacagagattcgaagatgggaagacgaaggtggagctagagaagccaggaccattttatttcatcagtggggcaaagggtcactgcgagcagggccagaagctgatcgttgtggtcgtgacacctcgccggaggttcatcgggatctcacctgcgccttctccggcggaaagtgagggtcctgcggttgctccgtcgagtggagctggtaatttgaaggttgggcttttggcggtggttgtaggaattttgggtgttggtgttggtttggtttga

SEQ ID NO: 463 - protein, 178 aa, Cucumis sativus
MANFSIALSLFTFLLLFISFSEAREILVGGKSNAWKIPSSQSQSLNQWAETSRFRIGDTLVWDYEDGKDSVLKVTKEDYEACNTENPEQRFEDGKTKVELEKPGPFYFISGAKGHCEQGQKLIVVVVTPRRRFIGISPAPSPAESEGPAVAPSSGAGNLKVGLLAVVVGILGVGVGLV

SEQ ID NO: 464 - DNA, 546 bp, Citrus sinensis
atggctggcttttcaagaaccctagcttcttcttctttggtgctcacatcacttgttctcttcagcatcagcttctgcgaagcaagagacatcttggttggtggcaaaacagattcttggaaaatcccttcttcacaatctgattccctcaatcaatgggctgaaaaaactcgcttccaagtcggggattctctagtgtggaaatatgatgccaccagagactcagtgctgcaagtgacaaaagaagcttacctcagctgcaacacaagcagcccagttgctgagtacagggatggcaacaccaaggtgaagctgaacaaatctgggccattctacttcatcagtggaaccaagggaagctgtgagaaaggccagaagttgattgttgtcgtgatgtcttcgaggagaaggtacactggcatttctccggcaccggctccgatggagttcgatggtccggccgtggctcctacaagcagtgctgcaagctttaaggctagtttggtgctggcacttggaggtcttttggcttgggttctgttttaa

SEQ ID NO: 465 - protein, 181 aa, Citrus sinensis
MAGFSRTLASSSLVLTSLVLFSISFCEARDILVGGKTDSWKIPSSQSDSLNQWAEKTRFQVGDSLVWKYDATRDSVLQVTKEAYLSCNTSSPVAEYRDGNTKVKLNKSGPFYFISGTKGSCEKGQKLIVVVMSSRRRYTGISPAPAPMEFDGPAVAPTSSAASFKASLVLALGGLLAWVLF

SEQ ID NO: 466 - DNA, 537 bp, Populus trichocarpa
atggcttcctttcaaagagctgcagtgttttctttggtgttaatgtctctgctttggggctcgtcacaagctaaagatttgttggttggtggcaaaacagatgcatggaaaatcccatcttcagaatctgattctcttaacaaatgggctggaaaagcccgttttctcattggcgattctctagtgtggaagtacgatggccagaaagattcagtcttgcaagtgactaaggaggcttatgctgcctgcaacactacaaaccctattgaggaatacaaggatggaaacaccaaggtgaagcttgacaaatcagggccattctacttcatcagtggagctgagggtcactgtgagaaagggcagaaaattgttgtggtggttctgtctcaaaagcataagcaagtaggatacgtaggatctcctgctccttctccagttgagtttgtgggtcctgctgtggctcgaacaagcagtgcttcaaacttgagaggtggcttattggtggctttgggggttttggttctggggttgttctga

SEQ ID NO: 467 - protein, 178 aa, Populus trichocarpa
MASFQRAAVFSLVLMSLLWGSSQAKDLLVGGKTDAWKIPSSESDSLNKWAGKARFLIGDSLVWKYDGQKDSVLQVTKEAYAACNTTNPIEEYKDGNTKVKLDKSGPFYFISGAEGHCEKGQKIVVVVLSQKHKQVGYVGSPAPSPVEFVGPAVARTSSASNLRGGLLVALGVLVLGLF

SEQ ID NO: 468 - DNA, 525 bp, Lotus japonicus
atggctggttcctctgcttctcttttgctcctattccttctctttggcttctctgcagctaaggaactcttagttggtggcaagacagatgcatggaaggttccatcttctgaagcagattccctcaatcaatgggctgaaaagtctcgcttcaaagtcggagactatcttgtgtggaaatatgatggtgggaaagactctgtgttgcaagtaaacaaggaggactatggtagttgcaacacctccaaccccattgaagagtacaaagatgggaacactaaggtgaagcttgaccgtcctggacctcactacttcatcagtggagcaaagggtcactgtgagaaggggcagaagttgtttgtggtggttatgactccaaagcacagcagagacagagcaatttcccctgcatcttctccagcagagttggaagaaggtcctgctgttgctcctactagcagtgctacagttttgcagagtggctttgtggcggttctgggagtgttggctatgtacgtgatgtga

SEQ ID NO: 469 - protein, 174 aa, Lotus japonicus
MAGSSASLLLLFLLFGFSAAKELLVGGKTDAWKVPSSEADSLNQWAEKSRFKVGDYLVWKYDGGKDSVLQVNKEDYGSCNTSNPIEEYKDGNTKVKLDRPGPHYFISGAKGHCEKGQKLFVVVMTPKHSRDRAISPASSPAELEEGPAVAPTSSATVLQSGFVAVLGVLAMYVM

SEQ ID NO: 470 - DNA, 447 bp, Prunus persica
atggctggcttttcatcatcaagagctctatcttcatcttctctgttgctcatatttcttctcttcagcttctcagaagccagagagatattggttggaggcaaaacaggctcatgggcaatcccatcctctgaatcccaatctctcaacaaatgggctgaaagcacccgttttcgggtcggcgacactcttgtgttgaaatatgacagtgccaaagactcggtgttgcgtgtgaccaaggaagactacgctaactgcaatgtttcaaacccaattgaacagcacaaggatggtgaaaccaagcttcatcttgaccaaccagggccattctatttcatcagtggaaccaagggccactgtgagaaggggcagagggtgattgtggttgttatgaccccaagaaaacactatggtatctctccagcaccttctcccggcagaggttga

SEQ ID NO: 471 - protein, 148 aa, Prunus persica
MAGFSSSRALSSSSLLLIFLLFSFSEAREILVGGKTGSWAIPSSESQSLNKWAESTRFRVGDTLVLKYDSAKDSVLRVTKEDYANCNVSNPIEQHKDGETKLHLDQPGPFYFISGTKGHCEKGQRVIVVVMTPRKHYGISPAPSPGRG

SEQ ID NO: 472 - DNA, 555 bp, Fragaria vesca
atggcaatggcatcaagagctgcttctttgctagctgtcgtgtttctggtgttgttgagcttctcagaagccagagagtatttggtgggaggcaaatcagacgcatgggcagtcccttcttcggaatccgaatctctcaacaaatgggctgaaagcaaacggttcaggaccggcgacgttcttgtgtggaagtatgacggtgcaaaagactcggtgttgtatgtgagcaaggaagactatgtgaactgcaacacgtcaaacccaatgaagcagtacaaggatggcgagaccaagattgtgctggacaaatcaggacccttctacttcatcagcggaaccaaggaccactgtgtaaagggacagaagctcgttgttgtcgttatgtcccacagaaccagtccctcctccgccatctctccggcaccttctcccgccttcgatgtcacagacggtcccgccgttgctccagctccgactagcagtgcttcccctttcaaggccggtctcctcgttgttgtggccctcatggggttttcggcagctctgctcatctag

SEQ ID NO: 473 - protein, 184 aa, Fragaria vesca
MAMASRAASLLAVVFLVLLSFSEAREYLVGGKSDAWAVPSSESESLNKWAESKRFRTGDVLVWKYDGAKDSVLYVSKEDYVNCNTSNPMKQYKDGETKIVLDKSGPFYFISGTKDHCVKGQKLVVVVMSHRTSPSSAISPAPSPAFDVTDGPAVAPAPTSSASPFKAGLLVVVALMGFSAALLI

SEQ ID NO: 474 - DNA, 555 bp, Medicago truncatula
atggctggttcatcttcttgttctcttttggttctttttgttctgtttggttgtgcttttgcagctaaggatatcttgcttggtggcaaaactgatgcatggaaggttccttcttcggaatctgattctctcaacaaatgggcttcaagtgttcgttttcaagttggagaccatctaattttgaaatatgaagctggaaaagactctgttttgcaagtgagtaaggaagattatgatagctgcaacatctcaaaacccatcaaacattacaatgatgggaacacaaaagtgagatttgatcattctggtccatactactacatcagtggagaaaagggtcactgtgagaagggtcagaagcttactgttgttgtaatgagtctaaaagggggaagtaggcccattgttgctttttcaccatcaccttcaccagctgaggttgaaggtccagctgcctctgctgttgctccagctccaacaagtggtgctgctgttttgcaaggtggtggtgtttttgtggctgtaggagtgtttgttgccatgtggcttttctga

SEQ ID NO: 475 - protein, 184 aa, Medicago truncatula
MAGSSSCSLLVLFVLFGCAFAAKDILLGGKTDAWKVPSSESDSLNKWASSVRFQVGDHLILKYEAGKDSVLQVSKEDYDSCNISKPIKHYNDGNTKVRFDHSGPYYYISGEKGHCEKGQKLTVVVMSLKGGSRPIVAFSPSPSPAEVEGPAASAVAPAPTSGAAVLQGGGVFVAVGVFVAMWLF

SEQ ID NO: 476 - DNA, 540 bp, Saruma henryi
atggcatctgtaagatccttctctagttgtattgtcctccttgccctcttttacagcatctcagaagcaaaagagttcctggtcggaggcaagaatgatgcctggaaagtcccatcttctgaaccggattcactcaataaatggcccgaagcaaatcgttttcgtatcggcgattctctcgtttggaaattcgaagggtctaaagattcagttctgcaagtgagtaaagaggactaccaaagctgcaacatttcaagtccgatagcaacacgcaaaggaagtgaatcaaaggtgaagctagatcgatctgggcccttctttttcatcagtggagaacaagataattgtgtgaagggcgagaaggtgattgttgttgtcatgtcaactggaggcagagttttctttaatgcctctccggcgccttcaccggcaggactcgaaggtccagcgatgggtcctaccagtggggcctctggattgaggagtataggttgcggtatagtgggtgccttggtggttttggtgggagtggtgttttga

SEQ ID NO: 477 - protein, 179 aa, Saruma henryi
MASVRSFSSCIVLLALFYSISEAKEFLVGGKNDAWKVPSSEPDSLNKWPEANRFRIGDSLVWKFEGSKDSVLQVSKEDYQSCNISSPIATRKGSESKVKLDRSGPFFFISGEQDNCVKGEKVIVVVMSTGGRVFFNASPAPSPAGLEGPAMGPTSGASGLRSIGCGIVGALVVLVGVVF

SEQ ID NO: 478 - DNA, 555 bp, Mesembryanthemum crystallinum
atggctgtttcttcaagagtttgctcaatctctttggttttggcttttgccctgtttttgagcttcactgaggcaagagaccaccttgttggaggcaaagctgatgcttggaaaatcccttcttctgaagctgattctctcaacaaatgggctgaaaagaaccgatttcaaatcggcgataatctggtgtggaagtacgacagcaagaaagactcagtcttgcaagtgacaagagaagcctacttgagctgcaacaccaaaaacccaatagcagcccacaacgacggcgagaccaaggtggtgttggagaagtcaggcccatactacttcatcagtggaacacaggccaactgtgacaagggagagaagctcattgttgttgtcatggcggcccgaagcggagggtccagcgctgtttctcccgccctggcaccggccccgggtttggaatccgagggaccggcggttgctcaaactagtggtgcttctggggttaaggggtggaatgatggtggctgctggggtttttggtgggttccctatgatgtgagttga

SEQ ID NO: 479 - protein, 184 aa, Mesembryanthemum crystallinum
MAVSSRVCSISLVLAFALFLSFTEARDHLVGGKADAWKIPSSEADSLNKWAEKNRFQIGDNLVWKYDSKKDSVLQVTREAYLSCNTKNPIAAHNDGETKVVLEKSGPYYFISGTQANCDKGEKLIVVVMAARSGGSSAVSPALAPAPGLESEGPAVAQTSGASGVKGWNDGGCWGFWWVPYDVS

SEQ ID NO: 480 - DNA, 612 bp, Arabidopsis thaliana
atggcacgaaacctaaagagcatgatgctttgtgggtttggtctcttgtgttttcttatgatcgttgaccgagcctacgctagagagtttacggtcggtggtgcaacaggttggaccgtcccttctggttctcaagtgtacagtcaatgggcagaacagagcagattccaaattggtgactctctgttgttcgtctaccaatcaaaccaagattcagtgctccaagtcacaagagacgcttacgacagctgcaacacggactcaccaaccgctaaattcgccgatggcaaaacttctgtcacgctgaaccactctgggccatactatttcattagtggaaacaaagacaactgcaagaaaaacgagaagcttgtggtcatcgtcatggctgatagaagcggcaacaaaaacaccgcatcatcaccgccgtccccagccccagctccctcaggagaatccgctccttctccacctgtctcgggaacctttgagatgaccccagcaccgacgcctactacttctgaagacactccaaacagcgcagcttcttccttatcatttgtcgctgctcttcttggggctgctctagcttccactctattcctacactaa

SEQ ID NO: 481 - protein, 203 aa, Arabidopsis thaliana
MARNLKSMMLCGFGLLCFLMIVDRAYAREFTVGGATGWTVPSGSQVYSQWAEQSRFQIGDSLLFVYQSNQDSVLQVTRDAYDSCNTDSPTAKFADGKTSVTLNHSGPYYFISGNKDNCKKNEKLVVIVMADRSGNKNTASSPPSPAPAPSGESAPSPPVSGTFEMTPAPTPTTSEDTPNSAASSLSFVAALLGAALASTLFLH

SEQ ID NO: 482 - DNA, 669 bp, Medicago truncatula
atggctaccttcattttaaggtctaataaaatagtccatgccttgagctggttttgtctcatgctaatgattcataagagtgctgcatatgatttcatagttggtggccaaaagggttggagtgttccaagtgattccaacaatccttttaatcaatgggcagaaaagagccgttttcaagttggagactccctagtgttcaactaccaatctggcaaagactctgtgctttatgtaaagagtgaagactatgcaagttgcaacactggttcacctattacaaaattctctgatggtcacacagtcttcaaactcaaccaatcagggcctcatttcttcatcagtggaaacaaagataactgtctcaaaaatgagaaagtaacagtgattgttctgtctgacagaagcaacaacaacaattcatcaaacaccaaccaaacaagcaatgctactccaccatcacctcaatcatcatcacctccttcaccagcaccttctaaccaagagggtcaatctccacctccagacacgaaccaaacaccacctcctactgctactagtgatcatgatcatcctcctcgtaatggcgctgcttcaaactttgtcagtctagctggctctgttggaactttcatggcttcagctctaattttatccaagtatctatga

SEQ ID NO: 483 - protein, 222 aa, Medicago truncatula
MATFILRSNKIVHALSWFCLMLMIHKSAAYDFIVGGQKGWSVPSDSNNPFNQWAEKSRFQVGDSLVFNYQSGKDSVLYVKSEDYASCNTGSPITKFSDGHTVFKLNQSGPHFFISGNKDNCLKNEKVTVIVLSDRSNNNNSSNTNQTSNATPPSPQSSSPPSPAPSNQEGQSPPPDTNQTPPPTATSDHDHPPRNGAASNFVSLAGSVGTFMASALILSKYL

SEQ ID NO: 484 - DNA, 570 bp, Helianthus paradoxus
atggcaaactttgtcactagccaccataatccgacaatggctgccgccatcgtggcggttttaagccttttagtgttgattcagaatgcagatgcgtttgaattcaaagtcggcggttcaggggagtggagcctttcggcttcctacaatcaatgggccgagaaaaatcgatttcaagttggtgacacgttattgttcaagtacgacgatgataaagactcggtacttgaagtgagcaaagaagattatgacaactgtaataccggtaatcccattgcaaaacatgacgatgatcacaccgtgatcaagttggatcggtccgggccccactacttcataagtggagttgctgatcattgcaaaaacaatgagaagctgctggtggtggtaatggcggaccgaacccacaaatcaccaccagagtctccaccgtccccagctccatcaggcgaagagtcaccatctccaccagcggatgagaaaccgccatcttcgtctccaagtgacgcgtcttcggttgtcgtgagccttctttgcttcgttggagcaattgcttgttttttgagttga

SEQ ID NO: 485 - protein, 189 aa, Helianthus paradoxus
MANFVTSHHNPTMAAAIVAVLSLLVLIQNADAFEFKVGGSGEWSLSASYNQWAEKNRFQVGDTLLFKYDDDKDSVLEVSKEDYDNCNTGNPIAKHDDDHTVIKLDRSGPHYFISGVADHCKNNEKLLVVVMADRTHKSPPESPPSPAPSGEESPSPPADEKPPSSSPSDASSVVVSLLCFVGAIACFLS

SEQ ID NO: 486 - DNA, 597 bp, Lactuca perennis
atggcaaaaccggtcatcatcatcggtcatttaagtcttttgttgttgattctaaatgctaacgcgattcagttcatgattggaggttccggtgattggagtctcgcatcaacctcctataatcaatgggccgaaagaagtcgttttcaaattggagacacagttttgttcaagtacgaatctgggaatgactcggtggttcaagtaaccaaagaagattacgacaactgcaatgcagcatcacccattgcaaagtacgatgatggtaattccatggtcaagttgaatgaatcggggcctcattacttcataagcggacttgtagagaactgtaaaaagaacgaaaaggttgtgatcgttgtcatggcagatcggagcaaacgatcaccgccaagttctccaccgtctccggctccaacaggcgaagagtcgccatctcctccaccggccagcgacgagtcacagtctcctcccccagctccggcaactgaagataataacccaacaccatccccaaacggtgcaacatcgatcgtcacaagtttcgtgtactctattattgcttttgttggttcctcacttgtctttgttttttga

SEQ ID NO: 487 - protein, 198 aa, Lactuca perennis
MAKPVIIIGHLSLLLLILNANAIQFMIGGSGDWSLASTSYNQWAERSRFQIGDTVLFKYESGNDSVVQVTKEDYDNCNAASPIAKYDDGNSMVKLNESGPHYFISGLVENCKKNEKVVIVVMADRSKRSPPSSPPSPAPTGEESPSPPPASDESQSPPPAPATEDNNPTPSPNGATSIVTSFVYSIIAFVGSSLVFVF

SEQ ID NO: 488 - DNA, 666 bp, Solanum tuberosum
atggctcaaataacaagttcaagatcaaatagaaaagttttttatattttgggcttggtcaatattttgatgttgttacaaaatgccaattgttatgagtttaaaattggaggctctggagattggagtgtccctatggatgccaatgctaataattacaatcaatgggctgagaggaatagattccaaattggtgacactttatcttttcactactctgctgataaagactcagtgcttcttgtaaacaaggcagattttgacaattgcaacactgcttctcctattgagaagtatagtgatggacagagtgtggttaagtttaaccactctggtccatactacttcattagtggtgttcatgacaactgtgtcaagaatgaaaaggtgcaccttgtggtcatggctgatagaagtcaccacaaccaaacagcttcttctccccctccttccccatcagtagatgaagttcctccgtctccggccccgtctggtgaggaggcaccatcaccaccatctgactcaggtgagaccaacccaactccagctccttctcaagaatcatcacctccttctcctccgaagaatggtgcttcgtcgatcgccatgtgctttgttggccctgctgcagctttagctggattatctgtactgttgggattctga

SEQ ID NO: 489 - protein, 221 aa, Solanum tuberosum
MAQITSSRSNRKVFYILGLVNILMLLQNANCYEFKIGGSGDWSVPMDANANNYNQWAERNRFQIGDTLSFHYSADKDSVLLVNKADFDNCNTASPIEKYSDGQSVVKFNHSGPYYFISGVHDNCVKNEKVHLVVMADRSHHNQTASSPPPSPSVDEVPPSPAPSGEEAPSPPSDSGETNPTPAPSQESSPPSPPKNGASSIAMCFVGPAAALAGLSVLLGF

SEQ ID NO: 490 - DNA, 672 bp, Vitis vinifera
atggctgattccattctcacatcagatcacctgaaaaaggcattacatgtgttggggctcctgagtctcttgctgctgatgcagaaagttggtgcgactgagttcaaagttggaggcccaaatggttggtctgttcctgctgatgctgcactcagctataaccaatgggcggaaaggaatcggtttcaaaggggcgattctctgctgtttgtttacccggctggcaacgactcggtgctctatgtaaacaaggatgatcataacaattgcaacacggcaacacccctggaactgcacaaggatgggcacactactttcaagttgaatcagtctggtgctcactacttcataagtggggtagtagataactgtctcaagaatgaaaaactagtggtggttgttcttgcagagaggagcaaggaatctttaacccctgcttccccaccatctggatcaacagatatagtcccaccatctggatcaacagatatagtcccatctccggcacctgcaggcgaggaatctccttctccacctgaggggttggtgcagatagccccctccccacctcctggaggtgaggagccttctccaagtggagcttcatcggtatttatcagttttatcggttccatcggagctcttgttggttcatctcttcttctagcttga

SEQ ID NO: 491 - protein, 223 aa, Vitis vinifera
MADSILTSDHLKKALHVLGLLSLLLLMQKVGATEFKVGGPNGWSVPADAALSYNQWAERNRFQRGDSLLFVYPAGNDSVLYVNKDDHNNCNTATPLELHKDGHTTFKLNQSGAHYFISGVVDNCLKNEKLVVVVLAERSKESLTPASPPSGSTDIVPPSGSTDIVPSPAPAGEESPSPPEGLVQIAPSPPPGGEEPSPSGASSVFISFIGSIGALVGSSLLLA

SEQ ID NO: 492 - DNA, 666 bp, Populus trichocarpa
atggccaacatcagttaccaaaacaaagtctttcatgttttggggctcttgtgtttcttgctcttgatacagaagaacaatgcatttcaatatcaagtcggaggaggttcgaaaggttggaccgtgcccgataataccagttccagttcgaagagctactacaacgattgggctgaacgtacccgatttcggatcggagactccctcttgtttgcttatgatcctagccaagactcggtgcttcaagtaagcaagggggactatgaaaattgcaccacaaagaatcctattgcagcattcagtgaccctaagactgtcttcacattcaaccattccggacatcactacttcatcagtggaaacaaagataactgtctcaagaatgagaagttggtggtggtcgttttagcagacagatcaagcaatcattctgctaacacaaaccaaaccaccgcagctccttctccatctctgggttactccgacatggtcccagctcctacacctagcggtgttgagactcctcccgctcccgcaggaatagccgacataaacccaactccagctcccgccggtgtgtcaccaaactcagcttcttcattgttcgtgagtttcattggttccatgggagcattctttgcttcatctcttatcttatcgttttag

SEQ ID NO: 493 - protein, 221 aa, Populus trichocarpa
MANISYQNKVFHVLGLLCFLLLIQKNNAFQYQVGGGSKGWTVPDNTSSSSKSYYNDWAERTRFRIGDSLLFAYDPSQDSVLQVSKGDYENCTTKNPIAAFSDPKTVFTFNHSGHHYFISGNKDNCLKNEKLVVVVLADRSSNHSANTNQTTAAPSPSLGYSDMVPAPTPSGVETPPAPAGIADINPTPAPAGVSPNSASSLFVSFIGSMGAFFASSLILSF

SEQ ID NO: 494 - DNA, 660 bp, Ricinus communis
atggctaacaccgtttcaaggtcaaattaccagcacaagaatgcctttgctgtgttggggctcttttgtgtaatgctgatgttgcagaaaggtgatgctatacaattcactgttgggggagctaaaggttggaccgtgcccaaaaataccacagcatatgaatataatcaatgggcagaaaaaaccaggtttcagattggagactccttgttgtttgtctacaagccagaccaagattctgtgctcctagtaaacaaacaagactacgacagttgtactacaactgcagctctggctacctacgatgatggccacacggtctatacattcaaccgatcgggtcatttctacttcataagtggaaacaaagataattgtttaaagaacgagaagttaatagtggtcgttttggcagacagaagcaaccgttcttcttatacaaacgaaacgaccacagcttcgcctccaccttcaggcgaaatgggcatagtcccatctcctgcacctgctggcgaggaggctcctccagcaggaacagtggagaataacccatcaccatctccagttagcgataccccaaatgcggcttctgtcatatacatgagtttctcagctgccattggagcattttttgcttcatatcttattctaatattctga

SEQ ID NO: 495 - protein, 219 aa, Ricinus communis
MANTVSRSNYQHKNAFAVLGLFCVMLMLQKGDAIQFTVGGAKGWTVPKNTTAYEYNQWAEKTRFQIGDSLLFVYKPDQDSVLLVNKQDYDSCTTTAALATYDDGHTVYTFNRSGHFYFISGNKDNCLKNEKLIVVVLADRSNRSSYTNETTTASPPPSGEMGIVPSPAPAGEEAPPAGTVENNPSPSPVSDTPNAASVIYMSFSAAIGAFFASYLILIF

SEQ ID NO: 496 - DNA, 468 bp, Mesembryanthemum crystallinum
atggctaagggttttagctatgtcaattgctcattgcatgctcttgggctcttgagtcttgtgttgttgatgcagaaaggtgaagcaacaacatttcaagtaggtggctcaaagggctggagtgttccctctgataatagtcctgtttataaccaatgggctgaaagaatgaggttccaaattggtgattcactattgtttgtgtacccaacaagtgactcagtgctcagagtgacactagaggactacacaaagtgcacctcaagctcacccctagagaagttcactgatggccacactgagttcaagttcaagcaatcaggcccacactacttcatcagtggcaacaaagacaactgcctcaagaatgagaagcttcatgtggtggttttggctgataggagcaagaaggccacctcaccaccaccttctcctcagccctcggccgccactccaacccgcctctga

SEQ ID NO: 497 - protein, 155 aa, Mesembryanthemum crystallinum
MAKGFSYVNCSLHALGLLSLVLLMQKGEATTFQVGGSKGWSVPSDNSPVYNQWAERMRFQIGDSLLFVYPTSDSVLRVTLEDYTKCTSSSPLEKFTDGHTEFKFKQSGPHYFISGNKDNCLKNEKLHVVVLADRSKKATSPPPSPQPSAATPTRL

SEQ ID NO: 498 - DNA, 549 bp, Zingiber officinale
atggcaaactcgtcgctatgcctggttttagcctcctccttcatggttctatcattagctgctgggacacagttcaaggtaggtggctcgggaagatggagtgtgcctgacaacaatgccatgacctacaatcagtgggctgaaaaaaatagatttaagattggtgattccatagtgttcacgtacctcccggacgaagactctgttttgttagttgatgacgacgcttacaagaactgcaacacctcctcccacatagaccaattcaacgacggcaacacggtgttcaccttcacccactccggcaacttctacttcgtcagcggagtcaaagacaactgcgacaagaacgagaagctacacgtggtcgtcttggccgacaggacgaatacgagttcgccggcgcccgctcctcttcctgcttcggctccggcggaaggagccaccggggaaccatcgccgccgccgaatgcggccactgccaaggtggtcggcgtggtgagctcactgggggctgctgcgatcgcagctctttcgttcactttttga

SEQ ID NO: 499 - protein, 182 aa, Zingiber officinale
MANSSLCLVLASSFMVLSLAAGTQFKVGGSGRWSVPDNNAMTYNQWAEKNRFKIGDSIVFTYLPDEDSVLLVDDDAYKNCNTSSHIDQFNDGNTVFTFTHSGNFYFVSGVKDNCDKNEKLHVVVLADRTNTSSPAPAPLPASAPAEGATGEPSPPPNAATAKVVGVVSSLGAAAIAALSFTF

SEQ ID NO: 500 - DNA, 627 bp, Oryza sativa
atggcacacgggcgcgtgcagcggatgcaatgctgggtggtggtggcgtgcgtggtggcctcggtctccaccaccgcgtccgcgttcgtgttcaaggcgggcgggacgggcgagtggcgcgtcccggatcagcaggccagcggcaacgtcagcgcctacaaccagtgggccgagcacacccggtttcgcgtgggtgacgccatagcgttctcttaccaacccggcaacgactcggtgctgctcgtcgacaagagctcgtacgacgcctgcaacacgaacacgccgatcgacacgttcgccgacggcaacacggtgttcaccttcacccggtccggcccgtactacttcatcagcggcaacaaggacaactgcaaccgcaacgagaagctcatcgtcgtggtcatgggggagcgcgccgccaatggcacggcgccggcgccggcgctggccccgtcggccggcaccaccagcccgaactcgccaccgtcgccgccgcctcctccgtcgggcatcgagatctcgcccacgccggagcagtcgatcaacgccgcggcgcgccccagggcggcgggcattgccggcgcggccgggctggccattgggacgctgttctatgcactcgtttga

SEQ ID NO: 501 - protein, 208 aa, Oryza sativa
MAHGRVQRMQCWVVVACVVASVSTTASAFVFKAGGTGEWRVPDQQASGNVSAYNQWAEHTRFRVGDAIAFSYQPGNDSVLLVDKSSYDACNTNTPIDTFADGNTVFTFTRSGPYYFISGNKDNCNRNEKLIVVVMGERAANGTAPAPALAPSAGTTSPNSPPSPPPPPSGIEISPTPEQSINAAARPRAAGIAGAAGLAIGTLFYALV

SEQ ID NO: 502 - DNA, 639 bp, Sorghum bicolor
atggcgagctcatcatcttgcggtctggggctggcctgcttcgtgctcctggcggcatccgtcggcgccacgcagtacaaggtcggcggcgacaatggctgggccgtgccggacgccaccgccgagtccttcaacacctgggcggagaagaccagcttccagatcggcgacagcctcttgttcgtgtaccccaaggacaaggactcggtgctgctggtggagccggcggactacaacacctgcaacacctcctcctacgacaagcagttcaccgacggcagcacgtccgtcacgctcgaccgcgccggcgccttcttcttcatcagcggcgtcgaggccaactgccgcgccagcgagaagctcatcgtcatggtcggcagcggcggcgccagcgcgccagccccggccgcccagcagggctccggctctccctcgccgtcgacgtccgcgcctgctccctccaacggcgctccggtgccgccggcctcgcccaaggcccccgccgccaagaactccacggccaagggcgcccctccggccgccggcagcaatagcaacggcgctggtgctgggctcgccgtggcaggcttcgtcgcctcggttgcaggctgcgttgcctacgccacgcttgccttctga

SEQ ID NO: 503 - protein, 212 aa, Sorghum bicolor
MASSSSCGLGLACFVLLAASVGATQYKVGGDNGWAVPDATAESFNTWAEKTSFQIGDSLLFVYPKDKDSVLLVEPADYNTCNTSSYDKQFTDGSTSVTLDRAGAFFFISGVEANCRASEKLIVMVGSGGASAPAPAAQQGSGSPSPSTSAPAPSNGAPVPPASPKAPAAKNSTAKGAPPAAGSNSNGAGAGLAVAGFVASVAGCVAYATLAF

SEQ ID NO: 504 - DNA, 585 bp, Citrus clementina
atggcaactagaaatatgaatatggcacagctcgttatggctctagcttttgcagcaacactgctacacggcacagccgccgttgatcttgttgtgggcggcaacacgggctggacaatcccaccaaacaacaccttttattccaactgggcttctgctaacacctttcggatcggcgacactcttgtgtttaatttcgctactggagcacatgacttgactgtagtgacaaggcaagcttatgattcatgcagcacggccaacgccgtcaatcgcataacaaatggaccggcaagggttcgcctcaacacaactggtcagcactactacatatgcgggttccccggtcactgcgccgccggccaaaagttgaccgttaacgttgttggtaacaactccggcggctcagcccctgctccttctgccggcggcggccctggcacttctcccgcaccccctggtccttctggcaccggcactgatactactccttccacgcaagcaccgccaccttctgacactgccccaataggcgttagctttgctgccgtcttgatgttcgttgccgtaggcttgttctactag

SEQ ID NO: 505 - protein, 194 aa, Citrus clementina
MATRNMNMAQLVMALAFAATLLHGTAAVDLVVGGNTGWTIPPNNTFYSNWASANTFRIGDTLVFNFATGAHDLTVVTRQAYDSCSTANAVNRITNGPARVRLNTTGQHYYICGFPGHCAAGQKLTVNVVGNNSGGSAPAPSAGGGPGTSPAPPGPSGTGTDTTPSTQAPPPSDTAPIGVSFAAVLMFVAVGLFY

SEQ ID NO: 506 - DNA, 543 bp, Hevea brasiliensis
atggcaagaaaatcaagcatggcatttctcgcagcagttgttatcgctgctttgattcagagctctgtggctcagacacaacatattgttggtgataacacaggctggaatattcctactgggggtgctgcattctataccaattgggcttcaaaccaagacttttctgttaatgacattcttgttttcaactataacagtggagcacatgatgtggctgaggtgacaaaggaaaattatgactcatgcaataccaataacccaatctctctcaattccaccgcaccaacaagaatcactctcactgccggtgagcatttctacatttgtaccatctccggtcactgctctgctggccaaaagctagctatcaatgtcaccggcagcggcaccaccacaccaccatcctccacaactccaaccaccccatcttccccatctccaactaccgcccctcctccaccagacagctctgctaggtccctgagcgtcgcgggtctctccgccaccttcttgtcgatcgttgtagctttcttatattag

SEQ ID NO: 507 - protein, 180 aa, Hevea brasiliensis
MARKSSMAFLAAVVIAALIQSSVAQTQHIVGDNTGWNIPTGGAAFYTNWASNQDFSVNDILVFNYNSGAHDVAEVTKENYDSCNTNNPISLNSTAPTRITLTAGEHFYICTISGHCSAGQKLAINVTGSGTTTPPSSTTPTTPSSPSPTTAPPPPDSSARSLSVAGLSATFLSIVVAFLY

SEQ ID NO: 508 - DNA, 612 bp, Lotus japonicus
atggcaatgaacatgaacgctctcctccttgcgcttcttgcagcaaccgccttgttccactgctcatcagctcagaccagacacgtcgttggtgattcagcaggctggttcgtccctggcaacacttcattctacaccagctgggctgccaagaataccttcgctgtcggcgacactctcgtgttcaactacgcagcaagtgcacacaacgtagaggaagtgacaaagacaaattacgattcttgcaactcaacatctccaattgcaacttacaccaccccacctgtgacagtgaccattaaaaaaaccggtgctcattacttcatctgcggcgttcccggccactgcctcggcgatcaaaagctctccatcaatgtcgccagtggcagcagcgccgccactcctccttcatccactgctactccgccttcatcatccaccactcctccaccaccatcatcaaccaccactccttcaccatcatcacccacctctccttcaccatcatccaccgttaccccacctcctaaggactccgccgccgtgtctctcggtgctgccggagtggttgccagcacggtgatgacaatcgccgcggtttttttcttctag

SEQ ID NO: 509 - protein, 203 aa, Lotus japonicus
MAMNMNALLLALLAATALFHCSSAQTRHVVGDSAGWFVPGNTSFYTSWAAKNTFAVGDTLVFNYAASAHNVEEVTKTNYDSCNSTSPIATYTTPPVTVTIKKTGAHYFICGVPGHCLGDQKLSINVASGSSAATPPSSTATPPSSSTTPPPPSSTTTPSPSSPTSPSPSSTVTPPPKDSAAVSLGAAGVVASTVMTIAAVFFF

SEQ ID NO: 510 - DNA, 396 bp, Helianthus tuberosus
atgagtgctttcaattttaatatggttatgttgatggccatggttgcatccatggcattttgtagctcggcgacacaacatacggtgggcgacgcctctggctgggttattcctagcaacccaaatctctatactgactgggtatctcaaaggatgttcattgttggtgactctctagtctttgactttcccaccggaacacatgatgtaacagaagtgtctaaggatgactacgatcattgtcacgttggtaacccaacatccatcataaaaaccggccctgcaaccatcaacttgaccagccctggagatcactattacatctgttcattggagggacattgcctgtttcatcagaaattagcaattaatgttgtaatgaattcttcattttaa

SEQ ID NO: 511 - protein, 131 aa, Helianthus tuberosus
MSAFNFNMVMLMAMVASMAFCSSATQHTVGDASGWVIPSNPNLYTDWVSQRMFIVGDSLVFDFPTGTHDVTEVSKDDYDHCHVGNPTSIIKTGPATINLTSPGDHYYICSLEGHCLFHQKLAINVVMNSSF

SEQ ID NO: 512 - DNA, 549 bp, Helianthus exilis
atgagaatatacccgattgggtttgtgttgttggtattggttacttgtggcatatcatgtttagccatagattataccgttggagactctgctggatggtcacttagcgttgattatagcacttgggcttcaggcaaaaaattcaatgttggagatagccttgtgtttaactatggaagtagtcacacggtagctgaagtgagcgcagacgactatgataaatgcaacgtcgcaaactccataatgtcgtactcctccagccccaccacagtcactctaaacaaaacaggcacacactacttcatttgtggtgtggttggacactgcagtggtgggatgaaggtggcggttccggtgaccggagacggtggtagtggtggtgccaccccagctccatctgggccagatggttcttcctccgccaagcctactcctacaccatcaagcggcaccggaaaggttccggcatcatcgtcaaccatttctccggtagtaatcatttggttgattagtttggtttctttagtgcttatgtttgttcttgcttga

SEQ ID NO: 513 - protein, 182 aa, Helianthus exilis
MRIYPIGFVLLVLVTCGISCLAIDYTVGDSAGWSLSVDYSTWASGKKFNVGDSLVFNYGSSHTVAEVSADDYDKCNVANSIMSYSSSPTTVTLNKTGTHYFICGVVGHCSGGMKVAVPVTGDGGSGGATPAPSGPDGSSSAKPTPTPSSGTGKVPASSSTISPVVIIWLISLVSLVLMFVLA

SEQ ID NO: 514 - DNA, 516 bp, Triticum aestivum
atggctgccatgagaaccattcttctcgtcgtggctgcgatggcagtcctgagcaccgcgtcagcggcgatctacaacgtgggtgagccgggcggcgcatgggaccttagcaccaactacgacacttgggcgtcctctagaaacttccaaacgagcgatcagatcgtcttcaagtactctcctcaggcacacgacgtcctcgaggtcagcaaggcagactacgactcttgcagcaccgccaaccctgtcaccaccttcaactctgggaatgatgttgtcaccctcaccgccaccggcacccgctacttcatttgtggtttccctggtcattgcgcgggcggcatgaaggttaagatcgatgtcattccaggctcctcctcttcggcacccgccccggccaatggcccaagtgcaagcaatgctcccccgccgactccggtctccgctgccaccaatgtgcgggccaccgggtttggcctcgctattttgcttgccgttgtcggcctcatcgcttga

SEQ ID NO: 515 - protein, 171 aa, Triticum aestivum
MAAMRTILLVVAAMAVLSTASAAIYNVGEPGGAWDLSTNYDTWASSRNFQTSDQIVFKYSPQAHDVLEVSKADYDSCSTANPVTTFNSGNDVVTLTATGTRYFICGFPGHCAGGMKVKIDVIPGSSSSAPAPANGPSASNAPPPTPVSAATNVRATGFGLAILLAVVGLIA

SEQ ID NO: 516 - DNA, 570 bp, Helianthus ciliaris
atggagaaggtggcagtggttgcaacgttgatggccatggtggtttgtggttcactgatggagacagccattgcagcggtgtacacagtcggagactcatccggatggaccaccattggtaatgttgattacaaacagtgggctgctactaaaaccttcaaagttggggatactgtagtattcacatacaacaagcagtttcacaatgtgatgcaagtcaaacatgccgactatagatcctgcaacgcctccgcacccattgcaacccactctactggcaatgactcgatcgtcatcaagacatacggccatcacttttacatgtgtgcggtcccaggacattgccaagccggacaaaaggttgacattaacgtcgaacgcgattcttctacaattgctccatctccatcgatatcagatccaccaacatcgtcttttttgccatctccatcctctgcccccacaagctccgcattaagtaagcctaagtcggtaggcaaagcaacttcatcaactatatcgcgtattacgctagggttggctatagctatgtttgttggtattgtgtga

SEQ ID NO: 517 - protein, 189 aa, Helianthus ciliaris
MEKVAVVATLMAMVVCGSLMETAIAAVYTVGDSSGWTTIGNVDYKQWAATKTFKVGDTVVFTYNKQFHNVMQVKHADYRSCNASAPIATHSTGNDSIVIKTYGHHFYMCAVPGHCQAGQKVDINVERDSSTIAPSPSISDPPTSSFLPSPSSAPTSSALSKPKSVGKATSSTISRITLGLAIAMFVGIV

SEQ ID NO: 518 - DNA, 549 bp, Triphysaria sp.
atgggctcaaatattcttgaaaaaagaggtttgagagttaatatggtaatgatgttagtgtcatttattatgaagttgtcaaatggagctgttcatagtgtgggagagacatctggttggaccattgttgggaatgttgattacaagagttgggctattgcaaaaacctttcatgttggtgatataatagtatttaattacagccctcagtttcacaatgtggttcgagttacacatgccgagtacaaatcatgcaacgtttcatccccaatctccacttacaataccggcaacgactcgatcaccatcgacactatgggccaccacttctttatatgcggcatgccgggccactgccaggcgggccagaaagtcgatatcaatgttcctcgtgcgccttcagtagtgtctggcccgttgggctcgccgccctctccagctcctattgttacagtaccagcaccttctcctagtggtgctccgagtatggcttttcagaatcttggatggattatacttcttttaccgtatgtgtttgggtcagcttga

SEQ ID NO: 519 - protein, 182 aa, Triphysaria sp.
MGSNILEKRGLRVNMVMMLVSFIMKLSNGAVHSVGETSGWTIVGNVDYKSWAIAKTFHVGDIIVFNYSPQFHNVVRVTHAEYKSCNVSSPISTYNTGNDSITIDTMGHHFFICGMPGHCQAGQKVDINVPRAPSVVSGPLGSPPSPAPIVTVPAPSPSGAPSMAFQNLGWIILLLPYVFGSA

SEQ ID NO: 520 - DNA, 723 bp, Vitis vinifera
atggctctcgccaagattttagcggctctcttgatggtcatggctctgtgtgaggtttctattgcggctactgtctaccacgtgggtgactctactggctggaccatcgggaaagttaattacaccctgtggtctcagactaaggacttcgtcgtaggagacaccattatctttgagtacagcaatcaatatcataatgtgctgcaagtgactcacgacaatttcaagtcatgcaacgcaacagctccgatcgccacattcgccaccggcaacgattcaatcaccatctcaaaatatggccacttctactacctctgtgggatcccaggccactgcgaagcaggacagaaggttgacatcagggttccacaccctcctgaaagtccaagtctcagtcccagccccagtcccatcaccagccccagccccagtcccatcaccagccccagtcccagtcccagtcccagccccagtcccatcaccagccccagccccagccccagtcccaaaccatggccaagtagtccgtctccatctccatctgcctggccaacaccaagttccccaccaccatcatggggaaattcacctgccccggcaccatattgggggattgcacctgccccggctccaagccctgcttcatctctccatgtttccatggggctgcttggtccttccatggcggttcttgcttttgtagtcactgcttttgcttattaa

SEQ ID NO: 521 - protein, 240 aa, Vitis vinifera
MALAKILAALLMVMALCEVSIAATVYHVGDSTGWTIGKVNYTLWSQTKDFVVGDTIIFEYSNQYHNVLQVTHDNFKSCNATAPIATFATGNDSITISKYGHFYYLCGIPGHCEAGQKVDIRVPHPPESPSLSPSPSPITSPSPSPITSPSPSPSPSPSPITSPSPSPSPKPWPSSPSPSPSAWPTPSSPPPSWGNSPAPAPYWGIAPAPAPSPASSLHVSMGLLGPSMAVLAFVVTAFAY

SEQ ID NO: 522 - DNA, 585 bp, Nicotiana benthamiana
atgtttttcaccaaggaagctatgcttttgctctcaacaatggctgttcttagtttgtttacagccacgctaggcgccgccgccgtgtacaaagtgggcgatgcagctggctggacgattggcggcgccaatgttgactaccatatgtgggcttcttctaaagctttccgggtcggcgacattcttgttttccagtacaaccgaacacaacacaacgtactacgagtgagcctccccgactaccactcgtgtaacgccgcaaatccaattgccacttactcctcgggcaacgactccatcaccatcaaaggtccgggtcactactactatatctgtggttttccgggccactgcaaggccggacagaagattgatgtcagggtgcttaaagtttctgagcccactgatttcagcagtaaaagcccaagttcagctccaaccccagcagccccatctcctaatgggcatgtaattgcacctagtccagtcacaaagagcagtgccccctcattgttcttgaataatgggcttaggctttccctcactttgttcatgattgttatttgtgcagtttatttattttaa

SEQ ID NO: 523 - protein, 194 aa, Nicotiana benthamiana
MFFTKEAMLLLSTMAVLSLFTATLGAAAVYKVGDAAGWTIGGANVDYHMWASSKAFRVGDILVFQYNRTQHNVLRVSLPDYHSCNAANPIATYSSGNDSITIKGPGHYYYICGFPGHCKAGQKIDVRVLKVSEPTDFSSKSPSSAPTPAAPSPNGHVIAPSPVTKSSAPSLFLNNGLRLSLTLFMIVICAVYLF

SEQ ID NO: 524 - DNA, 570 bp, Citrus sinensis
atggctaagctgcttcttcttcatcttcttgctattctttcaattgcattaacaagccatgccgcacaatattttgtgggtgatacttctggctgggatattagctctaacctcgatacatggccagacgacaaagtatttaaagtcggtgacgttttggtgttctcgtactcatcatccaacagtgtgagggaggtaacaaagcaaaattttgacacttgcaacataagcaatcccctgaaaacatattcaaacgggaacacgactgttacgttatcggctccaggtgaccggtatttcgtcagcggtaacaggttatattgctttggaggaatgaagcttcatgtgcatgttcctgcagatgaagtggcttcaccaattgggtcgcctcaagcacagccatcggccactggtactcctcttcctgtacagccttcttcaaagagcaataagccttcggctaatattccaacttcatctgggatatctagttatggtagaagcaattctgttgttgttgcttttgtgagttttatggcttcttatttgttgtggatggtgcaagcttga

SEQ ID NO: 525 - protein, 189 aa, Citrus sinensis
MAKLLLLHLLAILSIALTSHAAQYFVGDTSGWDISSNLDTWPDDKVFKVGDVLVFSYSSSNSVREVTKQNFDTCNISNPLKTYSNGNTTVTLSAPGDRYFVSGNRLYCFGGMKLHVHVPADEVASPIGSPQAQPSATGTPLPVQPSSKSNKPSANIPTSSGISSYGRSNSVVVAFVSFMASYLLWMVQA

SEQ ID NO: 526 - DNA, 546 bp, Marchantia polymorpha
atggctcgccaaggcagaagcattccactgttggttttggtagcgttcggagtgctggcagttttagtagaaaaggcatcggccatggacttttatgtgggtgatactactggttggggtgtgcctaatgaagcaaccacttatcaagattgggcttctaacaaaactttcctcgcggacgatgtcctcgtcttccagtatcagcaaggaacacacaacgttttgcaagtgtcgaagaaatccttcgaaaactgcaccatctctagccccatcgacaagttcgagagcggtaatgacagggtcactctgatcgactccgactattatttcatttgcggcatttccattcactgcacgctgaaccagaagctgcacgtcatagtgtcgaacaagtccgaggttcctgcaccaccatcgagccctctttcaccgccaccaaaagcatccccattaccacctccaggctcatcagcttccgcgcttcaacctgcaggagctctaatttccatgttgatgatggttggaattgcttctcttgcgttgtga

SEQ ID NO: 527 - protein, 181 aa, Marchantia polymorpha
MARQGRSIPLLVLVAFGVLAVLVEKASAMDFYVGDTTGWGVPNEATTYQDWASNKTFLADDVLVFQYQQGTHNVLQVSKKSFENCTISSPIDKFESGNDRVTLIDSDYYFICGISIHCTLNQKLHVIVSNKSEVPAPPSSPLSPPPKASPLPPPGSSASALQPAGALISMLMMVGIASLAL

SEQ ID NO: 528 - DNA, 540 bp, Beta vulgaris
atggctgtaatacgcatcgcattgccgttggtagttgtaatgtgctgcgttttgctgcaatctaccagcgcattgattcatgttgttggaggaactgcaggttggggagttccccctaacgccaccttctatacggattgggctaagcctagaacttttggtgctggtgacaaattagtgtttccatacagggtaggagcacacaacgttctacaagtaaataaaccagactttgacaaatgtggtcatgacaatgtggtaaacatgttctacaagggtccaacagtttttcagctcaatgccaccggtgactactacttctatagtggcattggtacccattgcgagctcggtcagaagctccacgtccacgttgtccccggccgcggttactccggccgcgggacacgcttcctcgaggttgttgtccatgctcttgcaccttctgctcctcacaactctgcccctactactactactactgccctaccatacttgggcttgttctcttgtttattgttggttgtgctccttatatga

SEQ ID NO: 529 - protein, 179 aa, Beta vulgaris
MAVIRIALPLVVVMCCVLLQSTSALIHVVGGTAGWGVPPNATFYTDWAKPRTFGAGDKLVFPYRVGAHNVLQVNKPDFDKCGHDNVVNMFYKGPTVFQLNATGDYYFYSGIGTHCELGQKLHVHVVPGRGYSGRGTRFLEVVVHALAPSAPHNSAPTTTTTALPYLGLFSCLLLVVLLI

SEQ ID NO: 530 - protein, 19 aa, Artificial sequence
  motif 19
  VARIANT (1)..(1): / replace = "His"
  VARIANT (4)..(4): / replace = "Ile"
  VARIANT (7)..(7): / replace = "Ser"
  VARIANT (10)..(10): / replace = "Ala"
  VARIANT (11)..(11): / replace = "Phe"
  VARIANT (12)..(12): / replace = "Lys"
  VARIANT (17)..(17): / replace = "Lys"
  VARIANT (18)..(18): / replace = "Ser" / replace = "Asp"
DSVLQVTKEDYDSCNTSNP

SEQ ID NO: 531 - protein, 11 aa, Artificial sequence
  motif 20
  VARIANT (1)..(1): / replace = "His" / replace = "Tyr"
  VARIANT (4)..(4): / replace = "Thr"
  VARIANT (8)..(8): / replace = "Lys"
  VARIANT (9)..(9): / replace = "Asp"
  VARIANT (10)..(10): / replace = "Asn"
FYFISGVPGHC

SEQ ID NO: 532 - protein, 21 aa, Artificial sequence
  motif 21
  VARIANT (2)..(2): / replace = "Thr"
  VARIANT (3)..(3): / replace = "Lys"
  VARIANT (6)..(6): / replace = "Ser" / replace = "Lys"
  VARIANT (7)..(7): / replace = "Ser"
  VARIANT (11)..(11): / replace = "Gln"
  VARIANT (12)..(12): / replace = "Val"
  VARIANT (15)..(15): / replace = "Thr"
  VARIANT (16)..(16): / replace = "Ile"
  VARIANT (17)..(17): / replace = "Leu"
  VARIANT (19)..(19): / replace = "Leu"
YNQWAEKNRFKIGDSLVFKYP

SEQ ID NO: 533 - protein, 29 aa, Artificial sequence
  motif 22
  VARIANT (1)..(1): / replace = "Asn"
  VARIANT (4)..(4): / replace = "Ser"
  VARIANT (5)..(5): / replace = "Val" / replace = "Lys"
  VARIANT (6)..(6): / replace = "Val"
  VARIANT (7)..(7): / replace = "Asn"
  VARIANT (8)..(8): / replace = "Phe"
  VARIANT (9)..(9): / replace = "Thr"
  VARIANT (11)..(11): / replace = "Pro"
  VARIANT (14)..(14): / replace = "Tyr"
  VARIANT (17)..(17): / replace = "Thr"
  VARIANT (20)..(20): / replace = "Ala"
  VARIANT (21)..(21): / replace = "Pro"
  VARIANT (22)..(22): / replace = "Asp"
  VARIANT (23)..(23): / replace = "Asn"
  VARIANT (27)..(27): / replace = "Asn"
  VARIANT (28)..(28): / replace = "Glu"
DGNTLFKLDRSGPFYFISGVKGHCEKGQK

SEQ ID NO: 534 - protein, 21 aa, Artificial sequence
  motif 23
  VARIANT (1)..(1): / replace = "Leu"
  VARIANT (3)..(3): / replace = "Lys"
  VARIANT (6)..(6): / replace = "Lys"
  VARIANT (7)..(7): / replace = "Ser"
  VARIANT (8)..(8): / replace = "His"
  VARIANT (11)..(11): / replace = "Gln"
  VARIANT (12)..(12): / replace = "Val"
  VARIANT (15)..(15): / replace = "Thr"
  VARIANT (17)..(17): / replace = "Val"
  VARIANT (19)..(19): / replace = "Lys"
  VARIANT (21)..(21): / replace = "Asp"
YNQWAEKNRFKIGDSLLFLYP

SEQ ID NO: 535 - protein, 21 aa, Artificial sequence
  motif 24
  VARIANT (1)..(1): / replace = "Gln"
  VARIANT (5)..(5): / replace = "Ile"
  VARIANT (11)..(11): / replace = "Ala"
  VARIANT (18)..(18): / replace = "Lys"
  VARIANT (19)..(19): / replace = "Ser" / replace = "Asn"
KDSVLQVTKEDYKSCNTSDPI

SEQ ID NO: 536 - protein, 50 aa, Artificial sequence
  motif 25
  VARIANT (5)..(5): / replace = "Val"
  VARIANT (8)..(8): / replace = "Lys" / replace = "Ala"
  VARIANT (9)..(9): / replace = "Gln"
  VARIANT (11)..(11): / replace = "Phe"
  VARIANT (12)..(12): / replace = "Asn"
  VARIANT (13)..(13): / replace = "Lys"
  VARIANT (17)..(17): / replace = "Ser" / replace = "Thr"
  VARIANT (22)..(22): / replace = "Phe"
  VARIANT (23)..(23): / replace = "Ser"
  VARIANT (25)..(25): / replace = "Asp"
  VARIANT (28)..(28): / replace = "Thr"
  VARIANT (29)..(29): / replace = "Val"
  VARIANT (32)..(32): / replace = "Ile"
  VARIANT (33)..(33): / replace = "Asp"
  VARIANT (34)..(34): / replace = "Ser"
  VARIANT (38)..(38): / replace = "Tyr"
  VARIANT (41)..(41): / replace = "Ile"
  VARIANT (44)..(44): / replace = "Ala"
  VARIANT (45)..(45): / replace = "Ser"
  VARIANT (49)..(49): / replace = "Gln"
  VARIANT (50)..(50): / replace = "Arg"
DSVIQVTEESYKSCNLKDPILYMNNGNSLFNLTRPGLFYFTSGVPGHCEK

SEQ ID NO: 537 - protein, 29 aa, Artificial sequence
  motif 26
  VARIANT (2)..(2): / replace = "Thr"
  VARIANT (5)..(5): / replace = "Asn"
  VARIANT (7)..(7): / replace = "Gln"
  VARIANT (8)..(8): / replace = "Leu"
  VARIANT (13)..(13): / replace = "Ser"
  VARIANT (14)..(14): / replace = "Ser"
  VARIANT (15)..(15): / replace = "Ser"
  VARIANT (16)..(16): / replace = "Asn"
  VARIANT (17)..(17): / replace = "Asn"
  VARIANT (20)..(20): / replace = "Leu"
  VARIANT (23)..(23): / replace = "Thr"
  VARIANT (24)..(24): / replace = "Ile"
PPSADPDVYTKWAKNHRFKIGDSLLFLYP

SEQ ID NO: 538 - protein, 15 aa, Artificial sequence
  motif 27
  UNSURE (1)..(1): Unknown amino acid
  VARIANT (4)..(4): / replace = "Ser"
  VARIANT (6)..(6): / replace = "Glu"
  VARIANT (7)..(7): / replace = "Phe"
  VARIANT (11)..(11): / replace = "Gly"
  VARIANT (14)..(14): / replace = "Gly" / replace = "Ser"
XVSCYQYKVGDLDAW

SEQ ID NO: 539 - protein, 50 aa, Artificial sequence
  motif 28
  VARIANT (3)..(3): / replace = "Leu"
  VARIANT (5)..(5): / replace = "Leu"
  VARIANT (26)..(26): / replace = "Glu"
  VARIANT (27)..(27): / replace = "Ala" / replace = "Asn"
  VARIANT (28)..(28): / replace = "Phe"
  VARIANT (29)..(29): / replace = "Asn"
  VARIANT (32)..(32): / replace = "Asp"
  VARIANT (34)..(34): / replace = "Ser"
  VARIANT (42)..(42): / replace = "Asn"
  VARIANT (49)..(49): / replace = "Leu"
HNFKIGDSLLFLYPPSQDSVIQVTAQSYKSCNLKDPILYMNDGNSLFNIT

SEQ ID NO: 540 - protein, 21 aa, Artificial sequence
  motif 29
  VARIANT (9)..(9): / replace = "Val" / replace = "Glu"
  VARIANT (14)..(14): / replace = "Gln"
  VARIANT (16)..(16): / replace = "Lys"
  VARIANT (21)..(21): / replace = "Val"
GDFYFTSGAPGHCEKSQKLHI

SEQ ID NO: 541 - protein, 21 aa, Artificial sequence
  motif 30
  VARIANT (13)..(13): / replace = "Ser"
  VARIANT (21)..(21): / replace = "Lys"
VSCYQYKVGDLDAWGIPTSAN

SEQ ID NO: 542 - DNA, 2194 bp, Oryza sativa; identical to SEQ ID NO: 85

SEQ ID NO: 543 - DNA, 56 bp, Artificial sequence
  primer: prm13192
ggggacaagtttgtacaaaaaagcaggcttaaacaatggtcaatcttagaagtcct

SEQ ID NO: 544 - DNA, 50 bp, Artificial sequence
  primer: prm13193
ggggaccactttgtacaagaaagctgggtctcatctgggttcttgtaata

SEQ ID NO: 545 - DNA, 1888 bp, Oryza sativa
actgttcgttgcacaaattgatgagcaatgcttttttataatgccaactttgtacaaaaaagcaggcttaaacaatgtaccgcgcggccgccagcctcgcctccaaggctcggcaagccgggagcagcgctcgccaggttggaagcaggcttgccttgagcaggaactatgctgccaaggatatcaagtttggagttgaggcccgtgctttgatgctgaggggtgttgaggagttggcagatgcagtcaaagtgacaatgggtcctaagggacgcaatgtggttattgagcagagctatggttcaccgaaagtcacaaaggacggtgtgactgttgccaagagcattgagttcaaggatagagtcaagaatgttggtgcaagccttgtaaagcaggttgctaatgcgaccaatgatactgctggagatggtaccacttgtgctactgtattgactaaagcaatatttactgaggggtgcaagtctgttgctgctggcatgaatgcaatggatttaaggcgtggtatttcaatggctgttgatgctgttgtaactaacctaaagggcatggctagaatgatcagcacatcagaggaaatagctcaggtgggcacaatatcagcaaatggggaaagggaaattggtgagcttattgcaaaggctatggagaaggttggcaaggagggtgtaatcaccattgcggatggtaacaccctttacaatgagcttgaagttgtggaaggcatgaaacttgacagaggctacatctctccttactttgttaccaacccaaagacccagaaatgtgaactggatgaccccttgatcctgatacatgacaagaaggtttcgagcctgcatgcagtagttaaagtcttggagttggctctgaagaagcaaaggcctctgctgattgttgctgaagatgtagagagcgaggcattgggtactctgattattaacaagcttcgtgcaggcatcaaggtctgtgctgttaaagctcctgggtttggggagaacaggaaagcaaacttacaggaccttgcgatccttactggaggagaagtcataactgaagagctaggaatgaatcttgagaagttcgagcctcagatgttgggtacatgcaagaaggtaactgtatctaaggacgacactgttattcttgatggagctggagacaagaaatccattgaagagagggctgagcagattagatctgcaattgagctaagcacttctgattatgacaaggaaaagctacaggagcggttggcaaagctctccggaggtgttgctgttctaaagatcggaggagccagtgaagctgaagttggtgagaagaaggatagagtgacagatgcattgaatgccactaaagctgctgtggaagagggtattgtaccaggtggaggtgttgcacttctttatgcatcaaaggagctggataaattgccgactgctaactttgatcaaaagattggtgtacaaatcattcagaatgctttgaagacaccggtgcacactattgcttccaacgcaggtgtagaaggggctgttgttgtcggtaagcttttggaacaagataacaccgaccttggctatgatgcggctaaaggtgaatatgtggacatggtgaaggctggtatcattgacccactaaaagtgatcagaactgccttggtggatgctgcaagcgtatcatctctgatgacaaccacggaatccatcatcgtagagatcccaaaggaagagaaggaggcgccagcgatgggaggcatgggtggaatggattactaaacccagctttcttgtacaaagttggcattataagaaagcattgcttatcaatttgttgcaacgaacaggtcactatcagtcaaaataaa

SEQ ID NO: 546 - protein, 574 aa, Oryza sativa
MYRAAASLASKARQAGSSARQVGSRLALSRNYAAKDIKFGVEARALMLRGVEELADAVKVTMGPKGRNVVIEQSYGSPKVTKDGVTVAKSIEFKDRVKNVGASLVKQVANATNDTAGDGTTCATVLTKAIFTEGCKSVAAGMNAMDLRRGISMAVDAVVTNLKGMARMISTSEEIAQVGTISANGEREIGELIAKAMEKVGKEGVITIADGNTLYNELEVVEGMKLDRGYISPYFVTNPKTQKCELDDPLILIHDKKVSSLHAVVKVLELALKKQRPLLIVAEDVESEALGTLIINKLRAGIKVCAVKAPGFGENRKANLQDLAILTGGEVITEELGMNLEKFEPQMLGTCKKVTVSKDDTVILDGAGDKKSIEERAEQIRSAIELSTSDYDKEKLQERLAKLSGGVAVLKIGGASEAEVGEKKDRVTDALNATKAAVEEGIVPGGGVALLYASKELDKLPTANFDQKIGVQIIQNALKTPVHTIASNAGVEGAVVVGKLLEQDNTDLGYDAAKGEYVDMVKAGIIDPLKVIRTALVDAASVSSLMTTTESIIVEIPKEEKEAPAMGGMGGMDY

SEQ ID NO: 547 - DNA, 629 bp, Allium cepa
agaaaatactgtaatatcatatcaaagagcgatttcaatctactttcagcaaattaactatttcaaattatcatgtatcgcccagctttgtacgccgcttcaaaagccaggtctgcttgcatcagcgggaaacaggttggaagccgacttagttggagaagaaactatgcggcaaaagatattaggtttggagttgatgctcgtgctttgatgcttaaaggcgttgaagagcttgccgatgctgtcaaagttactatgggaccaaagggacggaatgttgttattgagcaaagctttggtgcacctaaagttacaaaggatggagttactgttgcaaaaagcattgaattcaaggacagagtgaagaatatgggtgccagtcttgtgaaacaagttgctaacgcaaccaatgacagtgctggtgatggtacaacttgtgctactgttcttacaaaagcaatattctctgaaggatgcaagtcagtagctgctggaatgaatgcaatggatttaaggagaggaatcacaatggctggttgattctgttgttaccaatttgaagagcagggctaggatgatcagcaccctcggaagagattgctcaggttggaacaatatctgctaacgga

SEQ ID NO: 548 - DNA, 2052 bp, Arabidopsis thaliana
gcacaaagaaagttccagactattagcttttctaaaagaaaaaagtttcactctttggaggttggaacttaattccttgattaagaaaccccagaaaaaccctaaacccttgaagcgtctccttctctagttctttgcaagcggaaatgtatcgagtgctatcaaagttatcttcttcaattggctcgtctacttccaggaaactggtttctgggcggattataagtagcagaaactatgcggccaaggatatcagtttcgggatcggagctcgggcagctatgttgcagggtgtatccgaggttgcagaagctgtgaaagtcactatgggaccaaagggaagaaatgtgataattgagagcagttatggcggaccaaagatcacaaaggatggtgtcaccgtggcaaaaagcatatcatttcaagctaaagctaagaacattggtgccgaactcgtcaaacaggttgcaagtgccactaacaaggttgctggagatggtaccacttgtgccactgttttgactcaggcgatactcatcgaaggctgcaagtcggtggctgcaggtgtaaatgtgatggatttgcgtgttggaattaatatggcaattgctgcagttgtctctgatttgaaaagcagagctgttatgattagcaccccagaagagatcacacaggttgccactatatctgcaaatggggagcgtgaaataggggaactaattgcaagagccatggagaaagttggaaaggaaggggttatcactgttgctgatggtaacactttagataacgagctggaagtagtggaaggaatgaagctagccagaggttacatttctccttattttatcacggatgagaagacccagaaatgcgagcttgaaaatcccatcatcctcattcatgagaagaagatttcagacattaactctttgttgaaagttttagaagcggctgtgaaaagtagtagaccacttcttattgtagcagaagatgttgagagtgatgcattagctatgcttattctcaataagcatcatggtgggcttaaggtatgtgctatcaaggctccggggtttggtgacaacaggaaagcaagcttggatgatcttgcagttcttactggtgcagaggttatctctgaggagcgtgggctatctctagaaaaaattcgccctgaattgcttggaactgcgaagaaggttaccgttacccgtgatgacactattatcctacatggtggtggtgataaaaagctaattgaagaaagatgtgaagagttaagatcagccaatgaaaagagtacatccacttttgatcaagagaaaacgcaagaaagactctcaaagctatcaggtggtgttgcagtcttcaaggtgggaggggcaagtgaatctgaagttggagagagaaaagacagagtcactgatgctttaaacgccacaagagcagctgtagaagaaggcatcataccgggtggtggtgtggctctattatatgcgacaaaggctttagacaaccttcaaactgaaaacgaggatcaaagaagaggtgttcagattgttcagaatgctctcaaggctcctgcatttacaatagctgcaaatgccggttacgatggttctttagtggttggcaagttattagagcaagacgattgcaattttggtttcgatgcagccaaaggtaaatatgtggatatggtgaaagctggaatcatagacccagtcaaggtgatcagaaccgccttaaccgatgctgctagcgtttctttgcttttgacaacaacagaggcctcagtgcttgtgaaggcagacgagaacactccaaaccatgtccctgatatggccagcatgggcatgtgatcttgtgacctctacaaaaaaagaaacattcaaatttttatttttctctactaaagttagaaacttttctcgatttaaatttggttgtctggttctatatatattgttacagtgaatttttaatgaattttgttgaattcaaaaattatatcctgtggtcgtatattacgaactttgcttaagtgat

SEQ ID NO: 549 - DNA, 2107 bp, Arabidopsis thaliana
ggagaaaacgtaaaaccctaaaccctactgcttatagaatcttcgacgatctgcttcatttctcctcatctacgagtgagagaatttgtcaatttagcttctttagttcggtctgatctgaattaattgcaatcttctcggttgtgtgagagaatcaatcaccatgtatcggcttgtctccaacgttgcttccaaagctaggattgccagaaagtgtacaagccagattggaagcaggctcaattctactaggaattatgcagcaaaagacataaggttcggtgttgaagctcgggctttaatgcttaggggtgttgaggatcttgctgatgcagttaaagtcactatgggacccaagggtcgtaatgtcatcatcgaacaaagctggggtgcaccaaaggtgacaaaggatggtgtgactgttgccaagagcattgagttcaaggatagaattaagaacgttggtgccagtcttgtgaaacaggttgctaacgccacaaatgacgtagctggtgatggaacaacgtgtgccacagtccttactagagctatcttcacggaaggttgtaaatcagttgccgctggaatgaatgcaatggacctaagacgtggtatcaaattggcagttgatactgttgtgacgaacttgcagagccgagcacgcatgattagcacctctgaagaaatcgcccaagttggaacaatatcagctaatggagatagggaaattggtgaactgattgcaaaggctatggaaactgtcggcaaagagggagtgatcacaattcaagatggcaagaccttgtttaatgagctggaagttgttgagggtatgaagattgacaggggatacatctccccgtacttcataactaacccgaaaacacaaaaatgtgaactagaagatcctctcattcttatccacgagaagaaaatttccaatataaacgcaatggtgaaagtattagaactggccctcaagaagcaaaggccgctgctgatcgttgctgaggatgtggagagcgatgctcttgccaccctaattctgaacaaacttcgtgctaatatcaaggtctgtgctgtgaaggcccctggttttggagagaaccgaaaggccaatttacatgatctagctgccctcactggagcccaggtaataacagaagagttgggtatgaatctagacaacattgacctcagtatgtttggaaactgcaagaaggtaacggtatccaaagatgatactgttgttctcgatggggctggtgacaagcaagcaattggggaacgatgtgaacagatacgatccatggttgaagcaagcacttctgattatgacaaggagaagttgcaagaaaggttggctaagctttcgggtggtgttgctgtactaaagattggaggagcaagtgagacagaagttagtgaaaagaaagatagagtaacggatgctctaaatgccactaaagcagccgtagaggagggtattgttccaggtggtggtgttgctcttttgtatgcttcgaaagaacttgagaagctttccacagctaactttgatcagaaaattggtgttcaaatcattcaaaacgcactcaagacacctgtttacacgattgcttccaatgctggagtcgagggtgcagttgtcgtaggcaagcttttggaacaagataatcctgaccttggttatgatgctgctaaaggagaatatgtggacatgataaaggctggtattatcgatcctttgaaagtgatcagaaccgcattagttgatgctgcaagtgtttcgtctttgttgacaacgacggaagcagttgtgactgagattccaacgaaagaggtagcatctccgggtatgggcggtggtggcatgggcggcatgggtggcatgggcggtatgggaggaatgggtttctgaggagaactataaaccctgagtagggttctttggaatctgttgtgagagatgctacggttggttcatccacaagacactaatgtattctttaatcatgattggtagagagagaccttcagattttccgtgattttcaattcacaaacgatttataaactattttgaagaagatccttttccgattca

SEQ ID NO: 550 - DNA, 2129 bp, Arabidopsis thaliana
ctctctctctctctccgcctgttctccattgatctaatctaactcgctcatcagaatcatctcttcatcgttaatcctcttccttctcactcaccatgtatcgtttcgcttctaacctcgcctccaaggcaaggattgctcaaaacgctcgccaggtttccagcagaatgagctggagcaggaactatgcagcgaaagagattaagtttggtgttgaagctcgagctttgatgcttaagggtgttgaagatcttgctgatgctgttaaagtcaccatgggtcccaagggacgtaatgttgtgattgagcaaagttggggtgctcctaaagtgacaaaagatggtgttactgttgccaaaagtattgagttcaaagacaaaattaagaacgttggtgctagtcttgtgaagcaggttgcaaatgctactaatgatgttgctggtgatggtactacttgtgctactgtcctcacccgggctatatttgccgaaggatgcaaatcagttgccgcaggaatgaatgcaatggacttgcgaagaggtatttccatggcagttgatgctgtggtgacaaaccttaaaagcaaggctaggatgatcagcacatctgaagagattgctcaggttggaaccatttctgctaatggagagagggaaattggtgaacttattgccaaggctatggagaaggttggcaaagaaggtgttatcacaatccaagatggaaagacattgtttaacgagttggaagttgtagaggggatgaaattggacagaggttatacttcaccatactttatcactaatcaaaaaacccaaaaatgtgaactagacgatcctctcattcttatccacgagaagaagatctcaagcatcaactctatagtgaaagtgttggagttggctctgaagaggcaaagaccactattgattgtttctgaagatgtggaaagtgatgctcttgcaactcttatccttaacaagctccgtgccggaattaaggtctgtgccatcaaggcccctgggtttggagagaataggaaggccaatttgcaagaccttgctgcccttactggtggagaggttatcacagacgagcttggcatgaatctggagaaggtggacctaagcatgctaggaacctgcaaaaaggttacagtctccaaggacgacactgttattcttgatggggctggcgacaagaaaggaattgaggaaagatgtgaacagattaggtcagcaattgaactgagcacctcagattatgacaaggaaaaactgcaagaaaggttggctaagctctctggaggtgttgcagtgttgaagattggaggagcaagtgaagctgaagttggtgagaagaaagacagagtgacagatgctttgaatgccactaaagcagcagttgaagagggtattttaccaggaggaggtgtggctcttctatacgcagcaagagagttggaaaaacttccaacagccaactttgaccagaagattggtgtccagattattcagaacgcattgaagactcctgtttacacaatcgcttcaaatgctggagttgaaggtgctgttattgttggcaagctcttggagcaagataacccagacctcggttatgatgctgctaaaggtgaatatgtggatatggtgaaagctggaatcatagaccctctgaaagtgatcaggacagctttggttgatgctgcgagtgtgtcatctttgttgacgacaacggaagctgtagtggttgatcttccgaaagacgaaagcgagtcaggagcagcaggagcaggcatgggtggaatgggaggcatggactactagatccactaaattctgtcttttgttttcaccaatcaccatcttaacttgagaagagagatacgattcttttaggagttttagtcttcgtctttgccttattgttgctcaataacctcaaaagttttacaataaacagagcacacttggcaatgttacgagacacactattagcatcaacaaattttcctaaggcatcatttgtgtttgtcattgcttctggttcaggtctggtactccaacaataaaccgacccttcaaattacagtatttatatatatacccaagtttcatcgtagttaa

SEQ ID NO: 551 - DNA, 1725 bp, Medicago truncatula
atgtaccgatttgcttcatcacttgcctccaaagctcgaattgctaggagcaacgctaatcagattggaagtagggtggcatggagcagaaattatgctgccaaagagatcaaatttggcgtggaggctcgtgctttgatgcttaagggtgttgaagaacttgctgaggcagttaaagtaaccatgggtcctaagggccgtaatgtggtgattgagcaaagctttggtgcccctaaagtgacaaaagatggagtcactgtggctaagagcattgaattcaaggataaagtcaagaatattggtgccagtcttgtaaagcaggttgcaaatgctaccaatgatgtcgctggtgatggaaccacttgtgctactgttcttacccgagcaatatttacggaaggatgcaaatcagtagcagctggaatgaatgcaatggacctgaggcgaggtataaatatggctgttgatgctgttgtgacaaacttgaaaagcagagcacgaatgatcagcacttctgaagaaatagctcaggttggcacaatatctgctaatggggatagagaaattggtgagttaattgcaaaagccatggagaaagttggcaaagaaggtgtaatcacaattgctgatggcaagacattgcaaaatgagttggaagttgttgaaggaatgaagcttgaccgaggctacatttctccgtatttcataacaaaccagaagaaccagaaatgtgaactcgaggatcccctcattataatccatgagaagaagatctcaaatataaattctatagttaaagtattagagttagctttgaagaaacaaagacctttattgattgttgctgaggatgtggaaagtgatgcccttgcaactcttattctaaataagcttcgtgctggaattaaggtatgcgcgatcaaagcccctggttttggggaaaacaggaaatctggtctccaggatctcgctgttcttacaggaggtcaacttatcactgaagagctcggcatgaatcttgaaaaagttgatcttgaaatgtttggctcttgcaaaaagattacaatttctaaagatgacactgtcattcttgatggagccggtgataagaaatcaattgaggaaagatgtgagcagattaggtcggcagtcgaaaatagcacttcagattatgacaaggaaaaattacaggaaagattggccaagctttctggaggagttgcggtgcttaagattggaggagccagtgaggctgaagttggtgagaaaaaagacagagtaacagatgccttaaatgcaaccaaggcagctgtagaggagggcatagtacctggtggtggtgttgcacttctttatgcatcaaatgagttaagtaagcttccaaccgccaattttgatcagaagataggtgtccaaattatccaaaatgctttaaagacacctgtgcatacaattgcatcaaatgctggagtcgagggtgctgttgttgttggtaaacttttggaacaggataatcctgatcttggttacgatgccgccaaaggtgaatatgttgatatggttaaatctggaataattgatccattgaaggtgattaggaccgccttggttgacgcagccagtgtgtcgtctttgatgacaacaactgaagctgtcgtttctgaactcccaaaagaagataaagatactcctgccatgcctggtatgggtggtatggactattag

SEQ ID NO: 552 - DNA, 1731 bp, Medicago truncatula
atgtaccgatttgcttcatcacttgcctccaaagctcggattgctaggaacaatgttcaacaggttggaagtagggtggcatggaacagaaattatgctgccaaggagataaaatttggcgtggaggctcgtgctttgatgcttaagggtgttgaagacctcgctgaggctgttaaagtaaccatgggtcctaagggccgcaatgtggttattgagcaaagttttggtgctcctaaagtgaccaaagatggagtaaccgttgctaagagcattgagttcaagtgtaaggtcaagaatattggtgccagtcttgtaaagcaggttgctaatgctaccaatgatgtggctggtgatggaactacatgtgctacaattcttactcgagcaatattttccgaaggctgcaaatcagttgccgctggaatgaatgcgatggacctgaggcgaggtataaatatggctgttgacgctgttgtcacaagccttaaaagcagagcacggatgattagcacttctgaagaaatagcccaggtggggaccatatccgctaatggggacagagaaattggtgagttaattgcaaaagctatggagaaagttggcaaagagggtgtaatcacaattgctgatggcaagacattgcacaacgagttggaagttgttgaaggaatgaagcttgaccgaggctatatttctccgtatttcataacaaaccagaagaaccagaaatgtgaacttgaggatcccctcgtcataatccacgagaagaaaatctcaagtttaaatgctatagttaaagtattagagttagctttgaaaaaacaaagacctttattgattgttgctgaagatatagaaagtgatgcccttgcaactcttatcctaaataagcttcgtgccggaatcaaggtgtgtgccatcaaagcccctggttttggtgaaaatcggaaatctggtctccaggatcttgctgttcttacaggaggtcaacttatcactgaagaccttggccacaatcttgagaaagttgatctggaaatgtttggctcttgcaaaaagattacaatttccaaagatgacactgtcattcttgacggtgctggtgacaagaaagctattgaggaaagatgtgagcagatcaggtctgcagttgaaaatagcacttcagattatgacagggataaattacaggaaagattggccaagctttctggtggtgttgccgtgcttaagattggaggagctagtgaagctgaagttggtgagaaaaaggatagagttacagatgccttaaatgcaacaaaggcagctgtagaggagggcatagtacctggtggtggtgttgctcttctttatgcatcaaatgagttaagtaagctttcaactgccaattttgatcagaagataggtgtccaaattatccaaaatgctttaaagacacctgtgcacacaattgcatcaaatgctggagttgagggtgcggttgttgttggtaaactattggaacaggataatcctgatcttggttacgatgccgccaaaggtgaatatgttgatatggttaaagctggaattattgatccattgaaggtgattaggaccgccttggttgatgcagccagtgtatcatctttgatgacaacgactgaagctattgtgtccgatctcccaagtgaagataaagatggtcctgctatgcctgctggcatgggcggcatgggtggttattag

SEQ ID NO: 553 - DNA, 2149 bp, Oryza sativa
gaatcgaaattgcgaagccgcaagcaaagccgccggaggaaggagcaatcgcgagtactcgccaccatgtaccgggcggcggcggcggcggcgtcgtcgatttcgaggtcctcgtcggcgctgcggaagcagctgtcgcgcggcggttgcggggagcagcggctgtgggcgcgggggtatgcggcgaaggaggtggcgttcggcgtcggagcccgggccgccttgctgcagggcgtgaacgacctcgccgacgccgtcaaggtcaccatgggccccaaggggcgcaatgtgattatcgagagatcccatagagctcccaaagtcacaaaggatggagtcacggttgcaaaaagcattgagtttgaggacagtgctaagaatgttggtgcaaacctggtgaagcaagttgctgaagctactaataaggtcgcaggagatggtaccacttgtgcaactgtacttacacaggctattcttacggaaggctgcaaggctgtggcagcaggggtcaatgttatggacttacgtaatggcataaacaaggccataagttctatcactacacacctcaaaagtaaagcatggattatcaactcctcagaagaaataaatcaggtagcaactatttctgcaaatggagaaaaggaaataggagatttgatatcaaaggcgatggaaaaggttggaaaggatggagttattactattactgatggcaagacattagacaatgagcttgaagcggtacagggaatgaaactttccagaggctacatatctccttactttgtgactgatcagaagactcagaagtgtgagatggaaaatcctcttattctaattcatgacaagaaaatctcaacgatgaattcacttcttccagttttagaaatgtctatcaagaatcgtaggcctcttctcatcattgctgaggatgttgagggagaagctctatcaatgcttgttctgaacaagcatcgtgctggattaaagatatgtgctgtcaaagctcctggatttggtgaaaacagaagagccaatctggatgacgtggctgtgttgacaggaggagaggttgtcagcgaggaccaaggtcttgatcttggtaaagtcgaactacaaatgcttggcactgctaaaaaggttactgtatcccttgatgatactatcattctagatggtggaggcgacaaacagcagatagaggagaggtgtcaacagcttagagaatcaatggacaaaagcactgctgtatttgacaaagaaaaggctcaagaacgtctatcaaagttatctggtggtgttgctgtcctcaagattgggggagctagtgaagttgaagttggtgagaaaaaagatagggtaacagacgctttacatgcagcaagggctgctgtggaggagggcattgtaccaggtggtggagttgcccttctgtatgccaccaaggagcttgacaagattatcacagcaaatgaggatgaaaagattggagttcaaattatcaagaatgctttgaaggctcctttgatgactatagctgcaaatgctggcattgatggtggtgtggtcattgggaagctaattgaacaagataatcttaatatgggctatgatgcagcaagaggggagtatgttgacatgattaaggctgggatcatcgaccctgtgaaagtcatccgaacagcgctacaagatgcatcaagtgtttctttgctgatgacaacgacagaggcagctgttgctgagcccccagcagcaaaggccagaatggctagtcggatgccgcagatgagcgggatggatttttgagagcaagtaacatgatttatgatatgtcttctcctgatgtaaggcagtgcccctcaaatgaaaggggtgattttttgaaagctatatgacgtgattttgtcttttcgtggtgaaaggcagtagtagtacttaatatttctacagaatttcacggcccgggagaaagacgttacagatataatttattttaaacttgggaattgggaatccgtctgatgtaaactgaactaatgtggagcagcacctcattttgtagattactacatatgtgaaattgatactgtgaaagctgcaatattttactatgcattttggcaataattttgcctgcgcaaaa

SEQ ID NO: 554 - DNA, 2229 bp, Oryza sativa
gtggatggatgcttctagagcctcctcgcgtcttctcctctctcatcaaatcccctcgccctcctctctttcctcctccccaagaaaaaaaaaggcttcatagctcaacctcctcgccgccgccgctcacctcccctcccctcccatccctcctcctccctagccccaggtcgctgctcggctccgccatgtaccgcgcggccgccagcctcgcctccaaggctcggcaagccgggagcagcgctcgccaggttggaagcaggcttgccttgagcaggaactatgctgccaaggatatcaagtttggagttgaggcccgtgctttgatgctgaggggtgttgaggagttggcagatgcagtcaaagtgacaatgggtcctaagggacgcaatgtggttattgagcagagctatggttcaccgaaagtcacaaaggacggtgtgactgttgccaagagcattgagttcaaggatagagtcaagaatgttggtgcaagccttgtaaagcaggttgctaatgcgaccaatgatactgctggagatggtaccacttgtgctactgtattgactaaagcaatatttactgaggggtgcaagtctgttgctgctggcatgaatgcaatggatttaaggcgtggtatttcaatggctgttgatgctgttgtaactaacctaaagggcatggctagaatgatcagcacatcagaggaaatagctcaggtgggcacaatatcagcaaatggggaaagggaaattggtgagcttattgcaaaggctatggagaaggttggcaaggagggtgtaatcaccattgcggatggtaacaccctttacaatgagcttgaagttgtggaaggcatgaaacttgacagaggctacatctctccttactttgttaccaacccaaagacccagaaatgtgaactggatgaccccttgatcctgatacatgacaagaaggtttcgaacctgcatgcagtagttaaagtcttggagttggctctgaagaagcaaaggcctctgctgattgttgctgaagatgtagagagcgaggcattgggtactctgattattaacaagcttcgtgcaggcatcaaggtctgtgctgttaaagctcctgggtttggggagaacaggaaagcaaacttacaggaccttgcgatccttactggaggagaagtcataactgaagagctaggaatgaatcttgagaagttcgagcctcagatgttgggtacatgcaagaaggtaactgtatctaaggacgacactgttattcttgatggagctggagacaagaaatccattgaagagagggctgagcagattagatctgcaattgagctaagcacttctgattatgacaaggaaaagctacaggagcggttggcaaagctctccggaggtgttgctgttctaaagatcggaggagccagtgaagctgaagttggtgagaagaaggatagagtgacagatgcattgaatgccactaaagctgctgtggaagagggtattgtaccaggtggaggtgttgcacttctttatgcatcaaaggagctggataaattgccgactgctaactttgatcaaaagattggtgtacaaatcattcagaatgctttgaagacaccggtgcacactattgcttccaacgcaggtgtagaaggggctgttgttgtcggtaagcttttggaacaagataacaccgaccttggctatgatgcggctaaaggtgaatatgtggacatggtgaaggctggtatcattgacccactaaaagtgatcagaactgccttggtggatgctgcaagcgtatcatctctgatgacaaccacggaatccatcatcgtagagatcccaaaggaagagaaggaggcgccagcgatgggaggcatgggtggaatggattactaatcaacacccattaaagtaaactaaaaacatactcctgggatttaggattttttttgcggtgcaagttcatcgtcgatgtattttttgttcttgttgatgaggtggttgtcagacaattttgattccactggcggtaggacgggttggaacgaataaaattttagttcagagctaggagttcttgagagctgaggactgcacttcgatcaaaattgaatctgacaccttgtgccggaacatttttatgagctgatctgaaagattacgccttttggcctgaggtggtgtgcagttgtttttattcattctctttagt

SEQ ID NO: 555 - DNA, 2269 bp, Oryza sativa
gatggatccttctagaaaccccacccgcccgcctctccctcttcctcgcgtttctttccccctccacaagtagctctctccccgccggtctccgggtagccgcctccgaacccagccgagagctcgaagcctttccttactctcttgccatgtaccgcgcggcggccagcctcgcctccaaggcccgtcaagccgggagcagcgctcgtcagattgggagtaggctcgccttgcatagaaactatgctgccaaggacatcaagtttggtgtcgaggcccgggccttgatgttgaggggtgttgaggagttggctgatgcggtcaaagtgacaatgggtcctaagggacgcactgttgttattgagcaaagctttggtgctcctaaagttacaaaggatggagttactgttgccaagagcattgaattcagtaacagggttaagaatgttggtgcaagccttgtgaagcaggttgctaatgcgactaacgacactgctggggatgggacaacatgtgctactgttcttacaaaagctatattcgctgagggatgcaagtctgtagcagctggaatgaatgcgatggatttgagacgtggtatctcgatggctgttgatgaagtagtgacaaatttaaaaggcatggccagaatgattagcacatcagaggaaatagcacaggttggtactatatcagctaatggggaaagggaaattggtgagctcattgcaaaagctatggagaaggttggcaaagagggagtcatcactattacggatggtaacaccctctacaatgagcttgaagttgtagaaggcatgaaacttgacagaggttatatctctccttacttcattaccaaccaaaagaaccagaaatgtgaactagacgatccactgatcttgatacatgacaagaaagtgtccaaccttcatgctgtggtgaaagtgttggagttagctctgaagaagcaaaggcctctgcttattgttgcagaggatgtagaaagtgaagcattgggtactctgattattaacaagcttcgtgcaggcattaaggtttgtgcagtcaaagctcctgggtttggggagagcaggaaagccaacttacaggacctcgctatccttactgggggagaagtcataactgaagaacttggaatgaaccttgagaattttgagcctcagatgctggggacttgcaagaaggttacagtatctaaggatgacacagtcatccttgatggagctggagataagaaggccattgaagagagagctgagcagctgagatctgcaattgagctaagcacttctgactatgataaagagaagcttcaggagcggttagcaaagctttctggtggtgttgctgttctaaagattggtggagctagtgaagcggaggttggtgagaagaaggatagagtgactgatgcactaaatgctaccaaagctgctgtagaggagggtattgtaccaggtggtggagttgcccttctgtatgcatcaaaagacctggataaattgcagactgcgaactttgaccaaaagattggtgtccagatcattcaaaatgctttgaagaccccagtgcacacaattgcttcgaatgcgggtgtagaaggatctgtcattattggcaagcttttggaacaggataatactgatctaggttatgatgctgctaaaggtgaatacgttgacatggtgaagtctggtatcattgacccactaaaagttatcagaacagctctggtggatgctgcaagtgtgtcctctctaatgactaccacagaatctattattgttgagatccccaaggaagaggaggcagcagccgcagcacccgcaatgggtggcatgggcgggatgggtttctagcttactctccggctcatgcaaagttattgtgtgataaatttattcactagattagattatttttgcggtgcggacatctttaactgatgaggtggctgtcagattttgattctgctgcaagagaattgtaacttgaagtagtagaattgaactttggaatttgggatgcataaaatccttctatataggtggtgcaagttggattttgtgatttgctctgggtttgcctattttcgcttttgctcgagcaatccaagaacagtactacttcgataaatgtgcgagttccctgtgactggtccgtttagaattagtttaatcttaactttcagccacttctaactcaaagcaaagaatgaagctactgtggcaatttttccggattt

SEQ ID NO: 556 - DNA, 2615 bp, Physcomitrella patens
attgtttgaagcatgagagaaggctctgcttctagatgcttctagatgtccttccatcgatctggctgcttgtaacagactctgggtatcggtgattaactgttctctctccctaaggtggaggtcttaaggttccagtagacttgcgccatccacatttgcttcagtttttttgttggtttatttgtttattttgttttgtttgttttgtgtttttccttcttcttcttcggcgtttggcaatctgtgagttttttttggtcattgagttttcttgctgagggaattttaaggttagtgtgtggtatcgagggcttaagatctgaggtttaagatctgaggtttaagaacggttaagcaatcatgtatcgcgcggcggcagctttggcgtcccgagttaacagggggcgctcacttgtacaaaatttcagtaagttgcaatcaactcgacatttttctgcaaaggatatcaggtttggggttgaggcccgtgcccttatgctccaaggcgtggagcaacttgcagatgcggtacaagtgaccatgggccccaagggccggactgttattattgagcaatcatttggctctccgaaagtcaccaaggatggtgttactgtggccaaagccatagagttcaaggacaggctgcagaacgtgggagcatcactcgtgaagtcagtcgctagttctacaaatgacgttgctggagatggaacaacttgtgcaacagtgctcacccgagcaatttttgttgagggctgcaaatcagttgcagctggcatgaacgcaatggacctacgtagaggtattagtgttgctgttgatgccgttgtgtcctatctcaagagccaggctaagatgattagcacatcggaagaaattgctcaggttggaacaatctctgcgaatggagaccgagaaattggtgacttgctagctcgtgctatggagaaggttggcaaggagggtgtcatcactgtctctgacggaaaaactctgtttaatgagttggaggttgtggagggtatgaagctcgacagaggatatatctctccctatttcatcaccaattctaagactcaaaaagtggaattcgaaaatccagttatcttgatccacgagaagaagatcaacagtcttcaagcgatcctcccagtgcttgaacttgttgtcaaggatcaaaggcctctcctgattgttgctgaagatgtggaaagtgaagctttggctacgctgatagtcaataagcttaggggtggtgtgaaggtttgtgccatcaaggcccctggttttggtgagaacaggaaatcattaatgcaagaccttgccgtgttaactggtggtcagctcattactgaagacatgggattaaaactcgagaatatcacaccagatatgctgggacactgcaaaaaggtcaccgtatcgaaggatgacaccattatcttggatggcggaggtaacaaagctattctcgaagatcgtactgaacagatccgagaggccatcagcactgccacttccgattacgacaaggagaaattgcaggagaggttggccaaattgtcaggaggtgtagctgtacttaagattggaggagctagtgaagttgaggttagtgagaagaaagaccgtgttactgatgcattgaatgccaccaaagccgctgttgaggagggcattgttcctggtggtggtgttgctcttttgtatgcttcacgggagcttgacaatgttcaaacttcaaacttcgaccagaaggttggagtgcaaattattcagaatgccttaaagatgcctgcgtacacaattgcacgcaatgctggagtcgagggagctgtggtggttggaaagcttttggaggaagccaacttgaacattggatatgatgctgccaaagctgagtacgtcgacatggtgaaggcaggaataattgatcctgtaaaggtcatcagaacagcgcttgttgatgctgctagtgtcgcatcgcttcttacaacaactgaagcaatagttgccgatttccccaaggacgacgaggcaatgcctggtatgggaggaatgggaggcatgggaggcatgggggggatgtactagacaaagttaaggtatgctaatctcagtgcagtgctttgggtttaaagggatagactctcattgtatgaattgaaagacagtgcatgcgcaatgatcgagaaacccatctggcaaggtgccggaaaacaaaaagttttggtcacacgttgttattaaatagtcatttacgtggtcctcaggtatgaaacaatcgagaagtttcaattcgaggaaaattaatgtaatgcactcaacattgatatttttggactagacttatcctcgtgtttgaaagagactgggacaagaccgtatgccctaatgacgcttagcttagatttgcttcttcatttatatggtagccaatagacgagcataaccttgcaagtgctctaaaagataatcttacgaaacccaaactaaaccatgatgaatcacggtaaatgacttgaaactggacgcggttttgtgtagttgagtgctaaaactttatggaggcagatcatcgttctaatatatttatcttgtctattact

SEQ ID NO: 557 - DNA, 2402 bp, Physcomitrella patens
gtgctcttccacgtcgaaggtttgaggcccctctctagactcacgcaacccagctactggtctcgcacttctcacaaccattctacctcctcaccaccttctttcctttgtcaagctcgatcgaagtgtgggttttttttcttttggttttgtgggtttgcgcattcccgggaggtttaaggtcggtgtgggtggtatcggaggtttaaggtttaagaaaaaaacaggggttcggctaccatgtatcgtgcggcggctacgttgtcggcccgtatcaacaggggccgcgcactagtacaaaattttaataaacttcagtcaacccggaatttttctgcaaaagatattaggtttggggtcgaggcccgcgcccttatgcttcaaggtgtggagcaacttgcagatgctgttcaagtgaccatggggcctaaggggcgtacggttgttatcgagcaatcatttggctctccaaaagtgactaaggatggggtcactgtggctaaagccatcgagttcaaggacaggctgcagaatgtgggagcgtcccttgttaaatcagttgctagttctacaaatgatgtagctggagatgggacaacttgtgcaacggtgctcacccgagctatttttgttgagggatgtaagtcagttgcagctggcatgaatgcaatggacttacgtaggggtatcaatcttgctgttgactctgtcgtatcccatctaaaaagccaagccaagatgattagcacatcggaagagattgcacaggttggaactatctctgcaaatggagatagtgaaattggcgatttgctcgctcgcgccatggagaaggttggcaaggaaggtgtcatcactgtgtcggatggaaagactttatttaatgagttggaggttgtggagggcatgaagcttgacaggggatatatttccccctatttcatcactaatgcaaagacccagaaagtggaattggaaaatcccgtcatcttgatccacgagaagaaaatcaacagtcttcaagcgattcttccagtgcttgagctcgttgtcagggatcaaaggccactattgattgttgccgaggatgtggagagtgaagctctggcgacactgatagtcaacaagctcaggggaggtgtgaaggtgtgtgctatcaagtctcctggatttggagagaacaggaaagcgctcatgcaggaccttgcagtgttaacaggtggtcagctcattagtgaagaccttggatttaaactcgagaaggtcactcccgatatgcttggaaagtgcaaaaaggtcactgtatcgaaagatgacaccattatcttggatgggggaggtgacaaggctgcgctcgaagagcgaactgaacagatccgagaggctatcagcgctgccacttccgactacgataaggagaaactgcaagagaggttggctaaattgtcaggtggtgtagcggtacttaagatcggaggagctagtgaagtcgaggtaaacgagaagaaagaccgtgtaactgatgcattgaacgccactaaagctgctgttgaggagggtattgttcctggtggtggtgtggctcttttgtatgcttctcgagagctggagaaagttcaaactgcgaactttgaccagaagatcggagtgcaaatcatccaaaatgctttgaggatgcctgcgtacacaattgcacgcaatgctggagtggagggagctgtcgttgttggaaagcttatggagcaaacaaacatgagcattggatatgatgctgcaaaagccgagtacgtcgacatggtgaaggctggaattattgatcctgtaaaggttattagaacagctcttgttgatgccgctagcgttgcatcactgatgacaacaactgaagcagtaattgctgatttcccgaaggatgacaaggaggccatgcctggcatgggaggtggaatgggaggaatgggaggcatgggaggaatgtactagatgacttgagggatacgcaggcagttgaaatgtttcaaaatcaatgcgttgaggtttaggggacagccgctcattacagcgtttggaacaaagtgcatgcagtgatagggagattcatcctgcaagccgccggagaatagtctaattcggccatacaatgtaattaaagagtcagttttgtgatcctctaataagctcgaggaagattgacatggtccattcaaatcatgaatgtgtctcaacctaatacattcaattatttatttggatactgaacgcttttcttagactctttggccattgggtgtgggtgaggtagggaactgttaccttctagatttaaagctattatgagacaaaatgtcggaagatatgttgcttacacggatctgttaaaagaaacagtgcgcttgagtaac

SEQ ID NO: 558 - DNA, 2474 bp, Physcomitrella patens
catttgggggtagccggaagagagagaggaagatttaggaagatttagcaaactgccgctgcttctggaggcttctgaagctcctctcgttcatctcatgccgtttctcagactcataagtggtgatgaactgctagtcgccgcttcttctcgttttcagcttagaggcccatcatggtccttttcttctagctgccctgttgcttcgatcgcgacattgcatcttcttttaggggttctctcaggttgtggattctcttgtagagggaggttcaggttgtgtcgtgcctgaggttttaggtttgtgactgtagttcgccatgtatcgtgtggcggcagcattggcgtcccgcgtcagcaggggacaatcacttgtgcaagcatgtagattgcagtcagctcgcaaattctctgggaaggatatcaggttcggagttgaggctcgagctcttatgttgcaaggtgtggagcaacttgcagatgctgtgcaagtgaccatgggccccaagggccggactgttatcatcgagcaatcttttggatctcctaaagtgaccaaggatggtgttactgttgcgaaaagcattgaattcaaggacaggcttaagaacgtgggagcgtcacttgtaaaatcggtagcaaattctaccaatgacgtcgctggagatggaaccactgctgcaacagtgctcacacgagctatttttgctgaagggtgcaaatcagtagcagctggtatgaacgcaatggacttgcgcaggggcatcaaccttgctgtggaagcagttgtagctcatctcaagagccaagcgaagatgatcagcacatctgaggagattgcacaggtgggaacaatctctgcaaatggggatcgtgaaattggtgatttactagctcgcgccatggagaaagtaggcaaagagggtgttattactgttgcggatggaaaaactttgttcaatgaattggaggttgttgagggtatgaagctcgacagaggatatatttccccttacttcattaccaatgcgaagacacagaaagtggaactggaaaatcccgtgattttgatccacgagaaaaagatcaacagtcttcaatcaatccttccagtgcttgagcttgtggttaaggatcaaaggccattgttgatcgttgccgaagacgtagaaagcgaagctctggctactctgattgttaacaagctcagaggaggtgtctgtgcaatcaaggcacctggttttggtgagaacaggaaagcactcatgcaggatcttgccgtgattacgggtggtcagctcatcagcgaagacctgggattcaaacttgagaagattactccagtaatgcttggatctagcaaaaaggtaactgtatcaaaagatgacacgattatcttggatggcggaggtgacaagaccatcattgaagatcgtattgagacgatccgagaggctatcaacagcgcaacttctgattacgacaaggaaaagttgcaagagaggttggctaaattatcagggggtgttgctgtgctcaagatcggaggagcaagcgaagttgaggtgagtgaaaagaaagatcgtgttactgatgcactgaatgctactaaagctgctgtcgaggaggggattgtacctggtggtggtgttgctctattgtatgcttcccgggagcttgataagattcaaaccgcgaactttgatcagaaggttggagtgcaaatcatccagaatgccttgaagatgcccgcctacacaattgcacaaaacgctggtgtggaaggggctgtggttgttggaaagctgttggagcaaaccaatatgagcattggttatgatgctgctaaagccgagtatgttgacatggtgaaggcaggaatcattgatcctgtaaaagttattaggacttcacttgttgatgctgccagtgtcgcatcgctaatgacaacaactgaatcagtagttgctgattttaacaaagccgaggacaaggaaatgatgggaggcatgggaggcggcatgggaggcatggggggcatgtattagaaagtctaaggaaatggtagataaaattttcattagtgcgtggagttgactgtatacacgcactaataacatgcctcggaagaaagttggtgcagtgatcgggaaactcatttttgtccttctgtcagagaacacaaattttggccacacaatgtaatcaaagagtcaattttcgaaattctcgaactttcagttcgaaggagattgatatgacccattcaagtcgtatatgtctacacgcatggatacagtagcctatgtaaacaagcatatttcagaatccccatatcttttacttggtgcgttaatcattttagagcgttataatctcagtgtctaaattttcctaaaagcaagctaactgcatcgttttgagaacaattctggaatgagaataggtttggaggaaccagctgatttttactc

SEQ ID NO: 559 - DNA, 1743 bp, Physcomitrella patens
atgtttcgtgctgcggcagcattggcggctcatgtaaggtttcgaccacttgtgcgaaacttcgatcatttccagttggtccgatggttttcagcaaaagacatcaggtttggtgtggaagctcgtgctctcatgcttcaaggtgtggagcaacttgcagatgctgtgcaagtaacgatgggtcccaagggccgtactgtcgtcttagagcagtcgtatggctctccaaaaattactaaagatggagttacagttgccaagagtattgagtttaaggacaagctgaagaatgttggagcctcattagtgaagtctgtggcaaacgcgacaaatgatgttgcaggagacggtacaactgccgcaacagtgcttgctcgagccatttttactgaaggttgcaagtccgttgcagctggcatgaatgccatggacttgcgccgtggcattacacttgctgtggatgcagttgttgctcacttgaagagtcaggcaaagatgatcagcacatctgaagaaattgcacaagtagggaccatttctgccaacggagatcgtgaaatcggtgacttgctggctcgtgccatggaaaaagtcggcaaagagggtgtcatcactgtctctgatggtaaaacacttttcaatgaattagaagttgtggaaggcatgaagcttgacaggggttatatctcaccttatttcatcaccaacaacaaaactcagaaagtggaactcgagaatccagtcatactgattcatgaaaagaagattacaggcctacaatcaattcttccagttcttgagctggtggtcagggagcaaaggccattgctcatagttgcagaggatgttgaaagtgaagctcttgctacccttatcgttaataaaattcgtggtggagtgaaggtttgtgctatcaaggcacccggatttggtgacagcaggaagtccatattgcaggaccttgctgttttgactggtggtcagttgattagtgaagaccttgggttgaaactagagaaaatagaactagacatgcttggagcagctaagaaggttacagtatcaaaagatgacacaatcatcttggatggtgctggtgataaggctatcatagaggaacgtcttgaacagattcgagactcattgggtcaaactacatcagaatatgataaagaaaagttggaagagcgactagctaaactttcaggaggtgtagctgtcctcaagatcggaggaactagtgaagtggaagtcaatgagaaaaaagatcgtgtaacggatgccttgaatgccactaaagcagctgtggaagagggcattgtacccggtggtggtgtggccctcttgtatgcttcaaaagagctctataagatacctacaaataacttcgatcagagaattggggtgcagatcattcaaaatgcactgaagatgccagcctacactattgcacataacgcagggttggagggagccgttgtagttggcaaacttttggaccaatcgaaccttaatatcggttatgatgctgccaagggagagtacgtggatatggtgaaagctggaattattgaccctgtgaaagtaatcagaaccgcattcgtcgatgcagcaagtgttgcttccttgatgacgacgactgaagctgtagtcgcagaatccaacaaggaagaaaaggacttagtgcccagtacgggaggaggcataagtggtttgggcggaatgggtggcatgtatggctga

SEQ ID NO: 560 - DNA, 1136 bp, Populus trichocarpa
ttctctcttgtaagttttaataacactactatgcaccgcttcacttcgagcctcgcttctaaagctcggattgctaggagcagcaccaatcagattggaagtaggttgagttggagcagaaactatgctgccaaagacataagattcggtgtggaggctcgtgctgggatgctcaagggtgttgaagagctagctgatgctgtcaaagtcaccatgggccctaagggtcgcaatgtggttattgaacaaagctatggtgcccctaaagtgacaaaagatggtgtgactgttgctaaaagcattgaattcaaggataaagtcaagaatgttggtgctagcctcgtgaagcaggttgcaaatgccacaaatgatgctgcaggcgatgggaccacttgtgctacagttctcactcaagcaatatttactgaaggatgcaaatcagttgcagctggaatgaatgcaatggacctaagacgtggtatcagcatggcagttgaatcagttgttaccaatttgaagagcagagcaagaatgatcagcacatctgaagaaattgcacaagttggtacaatatcagcaaacggggagagggaaattggtgaattgatagcaaaggccatggagaaggttggcaaagagggagttataacaattcaagatgggaaaacattatctaatgagttggaagttgttgaggggatgaagcttgacaggggctatatatccccttatttcatcacagaccagaaaacccaaaaatgtgaattagatgaccctctcattctgatccatgacaagaaagtctcaagtttgcatgctgtggtgaaagtcctagagttggctttaaagagacaaaggcccttgctgattgttgctgaagatgtggaaagcgaggccttggcaactcttattttaaataagcttcgtgctggaatcaaggtctgttccattaaggcccctggtttcggagagaacaggaaggccatattgcaagatctggctgcactcacaggaggcgaacaagttcttaacttctgttttgcaggttataactgaagagcttggcctcaatcttgaaaatgtggatttggatatgcttggcagttgcaaaaaggtgagctcaaattgttgactgt

SEQ ID NO: 561 - DNA, 1763 bp, Populus trichocarpa
tcttctctcgtaattcttcttggcgatactatgcaccgcttcacttctagcctcgcttccaaggctcggattgctaggagcaccaccaaacaaattggaagtaggttgagttggagcagaaactatgctgccaaagacataagattcggtgtggaggctcgtgctgtgatgcttaagggtgttgaagagctagctgatgctgtcaaagtcaccatgggccctaagggtcgcaatgtggttattgaacaaagctttggtgcccccaaagtgactaaggatggtgtgactgttgcaaagagcattgagttcaaggataaagtcaagaatgttggtgctagcctcgtgaagcaggttgcaaatgccacaaatgatgctgcaggcgatgggaccacttgtgctacggtcctcactcgagcaatatttgctgaagggtgcaagtcagttgcagcaggaatgaatgcaatggacctaagacgtgaaattgcacaagttggtacaatatcagcaaatggggaaagagaaattggtgagttgattgcgaaggccatggagaaggttgggaaagagggagttataacaattcaagatgggaaaacattatctaatgagttggaagttgttgagggattgaagcttgacaggggctatatatccccttatttcatcacggaccagaaaacccaaaaatgtgaattggatgaccctctcattctgatccatgacaagaaagtctcaaatttgcatgctgtggtgaaagtactagagttggctttaaagagacaaaggcccttgctgattgttgctgaagatgtggagagtgaggcactggcaacacttattttaaataagcttcgtgctggaatcaaggtctgtgccattaaggcccctggttttggagagaacaggaaggctacattgcaggatcttgctgtcctcacaggagccgaagttataaccgaagagcttggcctcaatcttgaaaaggtggatttggatatgcttggcagttgcaaaaaggttacagtatcaaaggatgacactgttattcttgatggtgctggtgacaagaagtccattgaagaaagatgtgaacagatccgatctgcagtagagtcaagtacttctgactatgacaaagagaagttgcatgaaagactggcaaagctttctggtggtgttgctgtgctgaagattggaggagctagtgaagctgaagttggtgagaagaaagatagagttacagatgccctaaatgccacaaaggctgctgtggaagagggtattgtgccaggaggtggtgctgcacttctttatgcatcaaaagagttggataagctgcaaactgccaactttgaccagaagatcggtgttcaaattattcagaacgccctgaagacccctgtgcatacaattgctactaatgcgggagtcgagggagctgttgttgttggtaagctattggagcaggacaaccctgatctagggtacgacgctgccaaagatgaatatgttgatatggtgaaagctggcattattgacccgctgaaagtaattagaactgctttggtcgatgctgccagtgtctcctcgttgatgacaacaactgaggctgttataactgagcttccaaaggatgaaaatgatgctccggcaatgggtccaggcatgggcatggattactgaggttgatttttagagactgatccaacctgcctgacatagatatttgaacctttgtacccaatttatcgattcattgttcc

SEQ ID NO: 562 - DNA, 854 bp, Populus trichocarpa
gtaacttcttgatatataaaatatgtgtgaatggagcagctaataattctctactgtgcttcttttgtttttctatcttttcacagctcctctgcttcaaagaagcagttatccagtagggtcacatacagtagaagttatgtggctaaggatatcaattttggagttggggctcgtgcagctatgctacagggtgtcaatgaggttgcagaagccgtgaaagtcacaatgggaccaaagggccgccatgttattattgaaaaaagcaaggatggagtcactgttgccaaaagcatcaagttcaaggaaaaggcgaagagtgttggtgcagaccttgtgaagcaggtcgcaaatgctactaatactgccacgggggatggtgatctctcaacttcatgtacaacttgtgcaactgtcctgactcaggctatactcgtcgaaggctgcaagtctgtatctgctggtgtgaatgtgatggatttgcgtagtggcatcaatattgcggttggtggtgtcctttcagacttgaaaaagagagcattgatgataagcacaccagaagaaattactctggttgccactatctctgcaaatggtgaacgtgagattggagaaatgatagcaagagcaatggggaaagctggaaagcatggagtgattactgtcactgatgggaatactttggataatgagttggaagttgttgaaggaatgaagctagcaagaggctatatttctccctattttattactgatcagaagacccagaaatgagtaagttcatattagtctttcagcaagtatcaaaaaccaatcagcagattagcatattgatattaatgcgggacaataaa

SEQ ID NO: 563 - DNA, 1728 bp, Populus trichocarpa
atgtatcgttttgcctctggcctcgcctccaaagccagtggggtggctggcaacaacgccaagcagattggtagtagattggcttggaggagaaattacgcggctaaagacatcaaatttggtgttgaagctcgtgctttgatgcttagaggtgttgaagagcttgctgatgctgttcaagttaccatggggcctaaaggacgtaatgtagttttggaacaaagctggggggctcctaaagtgacaaaagatggtgtaactgtagcaaagagtattgaattccaagacagagttaagaacattggtgctagccttgtgaagcaggttgcaaatgctactaatgatgtggcaggcgatggtaccacatgtgcaactgtccttacccgtgcaatattcgctgaaggatgcaagtctgtggcagctggaatgaatgccatggaccttagacgtggcatctcaatggcagttgaagctgttgtgacaagcttgaagagcagagcaaggatgatcagcacatctgaggaaatagcccaggttgggacaatatcagcaaatggagaaagagagattggtgaacttatagccaaggctatggagaaagttggcaaagagggtgtcattacaatctctgatggaaaaacaatggataatgaattggaggttgttgagggaatgaagctggacaggggctatatatccccttattttatcaccaatgacaagaaccagaaatgtgaattagaagatcctctcattttaattcacgaaaagaagatctcaagcatgagttctactgtcaaagttttagaattggccttgaagaggcaaagacctttgctgattgttgctgaagatttggagggtgaggtactcgcaactctcattttgaacaagcttcgtgctggaatcaaggtttgtgccatcaaagcacctggatttggagaaaataggaaggccagtctgcaggatctttccattctcacagggggtcaggttataaccgaagagctcggcttgaaccttgataatgtgggattggaaatgcttggctcatgcaaaaaggtgacggtatcaaaggatgacactattattcttgatgggcttggtgacaagaaaaccattgaagaaagatgtgagcagttgagatctgctatcggaaccagcacctccgattatgataaagagaagttacaggagcggctagcaaaactttctggtggtgttgcagttttaaagattggtggagccagcgaagctgaagttggtgagaagaaagacagagttactgatgctctgaatgccaccaaggctgctgtagaggagggcattgtacctggtgggggtgttgcacttctttacgcctctaaggagcttgacaaattgcatactgcaaattttgatcagaagatcggtgtccagattatccagaatgctctcaagacacctgttcacactattgctagcaatgcgggggtagagggagcagttgttgttggcaagctattggagcaggacaaccctgaccttggatatgatgcagccaaaggcgagtatgtagacatggtgaaatcaggaattatcgatcctttgaaagtcattagaacagccttggtagatgctgcgagtgtgtcttccttgatgactacaactgaggcaattgtgtatgaacttcccaaggttgaaaaggaaaccccagcaagcaatggcatgagcggcatgggattttga

SEQ ID NO: 564 - DNA, 2127 bp, Solanum lycopersicum
ggagagaacgtggagaattcccagtcaagtctgctacttacggcagctccattctcccgtttcctctcacttttttcacactgttcgcttggtacaatgttcagagctgctgcagctgttgcttcatcaatcaggttctcaacctccaggaaattggtttctagtaggattatttctagcagaaattatgctgccaaggatatcagttttggtagccacgcacggttagctatgctgcagggggttaatgagcttgcagaagctgtaaaagtcactatgggaccaaagggacgtaacgtgattatagagaaaagccctgggaatcccaaggtcacaaaggatggtgtcactgtagccaaaagcatcaactttaaggaaaaggcaaagaatgtgggcgctgatcttgtgaagcaggttgctaatgctactaattcagttgctggagatggtaccacctgtgcaactgtgcttactcaggcaattttcacagaaggttgcaaagctgttgctgcaggtgtgagcgtgatggatttgcgtaatggtattaacatggccattgatgctgttgttgctgacttgaagagcagagcagtcatgattagcaccccggaggagattacacaggtgggtactatatctgcaaatggtgaacgtgaaattggggaaataattgctcgagccatggaaaaagttgggaaggaaggagttattactgttgcggatgggaataccttggataatgatttggaagtggtggaaggaatgaagcttggccgaggttatatatctccttattttgtcacggacgaaaagactcaaaaatgtgaattggaaaatccgttgatccttattcatgacaagaaaatctcagatttgaactcgcttgtgcggatattggagcttgctcttaagagaaggagccctctgttaatcgttgctgaagatgtggaaagtgatgcattagctatgcttatcctaaacaagcatcgtgctgggattaaggtatgtgccattaaagctcctggttttggggataatagaagagccaacttggaggacctagcagttcttactggaggagaggtcattagtgaagaacgtggtttggatctgagcaaagttcaatttgatatgcttggtactgccaaaaaggttactgtttcccttgatgacaccctagttctgcatggaggtggggacaaaaagctaattgaagaaaggtgtgagcagctaaggatagctaaagaaaaaagtagtgccatgtttgataaggagaaagctcaagagcgtttgtcaaagctatctggtggtgttgctgttttcaaggtcggtggggccagtgaggcggaggttggggaaaggaaagatagggttacagatgccttaaatgcaacaagggctgctgtggaagagggcattgttccaggtggtggtgttgctctcttatatgcaaccaaatgtctaaaaggccttcagactgcaaatgatggccaaaaaaggggagttgagatcattgagaatgctctaaaggcacctacttttacaatagcttcaaatgctggtgcagacggtgccttggttgtaggcaagctcttagaacaagatgatctgaatctaggatgtgatgcagccaaaggtacgtacctacacatggtgaaggctggaattattgatcccgtgaaggtagttagaacagcattaatggatgctgccagcgtctctttattattgacgacagctgaggctgccattgtggaccgtcaaggagaggaaaacccactcgcaaaccgtatgccaaacatgggcggtatgtactaatttagagaacacagatgaaacggttgatgatcttgctgtggctgtgatgaagcagtccttaggcgttccacgcatggtcccttcatacaagtttttttttgaatcttaaatggtttcttagtaattgattaggaagttatgtgaattcaccacaaatattgaacaaattaattatcccagtgtattaaaagtttttgtatgggattactggatagctcaaggtctcattgacctcttacttgccatgcccagaaagaaaataattcgctgctgctatttatttgcagtgtgtacaaaaaaaaaaaaaaa

SEQ ID NO: 565 - DNA, 2097 bp, Solanum lycopersicum
ggttgtttcttctagagccttctttgttcttctctaaataagcccaacttgttcatatctcctctcttcagttctctctcttttttctcagctgcaaaactttttcttgtaaaattatgtatcgttttgcagcaaaacttgcttctaaatccagggttgccagaagcagcacccaacaggttggtagtaggttgaattggagcagaaactatgctgctaaggatattaaatttggagttgaagctaggggaattatgcttcaaggagttgagcagcttgctgatgcagtcaaagtcactatgggtccaaagggtcgtaatgtggtgattgaacaaagttggggtgcacccaaggtgacaaaagatggtgtcactgttgcaaaaagcattgaattcaaggataaaataaaaaatgttggtgccagccttgtaaagcaagttgccaatgccactaatgatgctgctggcgatggtaccacttgtgcaacagtactcacccgagcaatatttgctgaagggtgcaagtctgtagctgctggtatgaatgcaatggatcttagacgaggtatcacaatggctgtcgatgctgttgtaacaaacctgaaaagcagagcacggatgataagcacatccgaggagattgcccaggttggtacaatctctgcaaatggagaacgggaaataggtgagataattgcaagggctatggagcaagtaggaaaagaaggtgtcatcactattcaagatggaaagacactgcttaatgatttgcaagttgttgaggggatgaagttggacaggggctacatatccccatacttcatcacaaatgagaagaatcagaaatgtgagctggatgacccacttattcttattcatgagaaaaagatctcaagcataaatgctattgtgaaagtgttagaattggctttgaagagacaaaggcccctcctaattgtgtccgaagatgtggagagtgaagcactcgctacacttattctgaacaagcttcgtgctggaatcaaggtttgcgccataaaagcaccaggatttggtgaaaacaggaaggctaatttgcaagatttggctgctttaactggaggccaggtcattaccgaagaacttggaatgaacattgaaaatgtggagttggagatgctgggtaaatgcaaaaaggtgaccatctccaaggatgacactgttgttcttgatggtgcgggtgagaagaaggccatagaggagagatgtgaacagattagatcagcaattgaactgagcacgtctgattatgacaaggagaaattgcaggaaagactagctaggctttcagggggtgttgcagtgttgaaggtaggaggagctagtgaagtcgaggttggtgagaagaaagacagagttacagatgctttgaatgccacaaaagctgctgtcgaggaaggaattcttccaggtggtggggttgcacttctttacgcatcaaaagaactggactcattgccaacagccaactttgaccagaagattggtgttcaaattattcagaatgctttgaagacaccagtatatacaattgcctctaatgctggggtggaaggatcagtagtggttggcaaactgttggagcaggataacccggatcttggatatgatgctgcaaaaggtgaatatgttgacatggtaaaagcaggaatcattgatccattgaaagtaattaggacggccttggttgatgctgctagtgtgtcgtctttattaactacaactgaagctgttatcgttgagcttcccaaggacgagaaggcagccccagctatgcctggtggtggtatggactactaatgcactagaaaagaacactgattcaaattgcctgacatacaatttagcacacagaaataagaaatttaaggttgttgctcatggtacctcaattgtaacactagcaagagatgtttttgtaggttgagaacttgtaatattttcaagacaatgcggctacctcatttttaatctacttccttgttctctgtgattatcactgaaatccaaaaattttcctgagtagtataaatgaattttcttgcagttgtgagattat

SEQ ID NO: 566 - DNA, 2115 bp, Solanum lycopersicum
ggggatcttctaggcccttcttcactaaattaaatacctttgaagcttcttcttcatccccacttctctctttgtacttcaaaatccctttccactttcactttcagcagcatttctcagcttcaaaatgtatcgttttgcagcaaatcttgcttctaaagccagtgttgcaagaaccagttcccaaaagattggtgggaggttgaattggagtagaaactatgctgcaaaggatatcagatttggagttgaagctagagctttgatgcttcaaggtgttgagcagcttgctgatgctgttaaagtcactatgggtccaaaggggcgtaatgtggtgattgaacaaagttggggtgcacccaaagtgacaaaagatggcgtgactgttgcaaaaagtattgaattcaaggacaagatacaaaatgttggtgctagccttgtaaaacaagtcgccaatgcaacaaatgatgttgctggtgatggtaccacttgtgcaacagttctcacccgagcaatatttgctgaaggatgcaagtcagtggcagctggtatgaatgcaatggaccttagacggggtattaccatggctgtagattctgttgtgacaaacctgaaaagcagagcacggatgatcagtacatctgaggaaattgcacaggttgggactatctctgcaaacggagaaagagtaattggcgacctcattgcaagggcaatggagaaagtaggcaaggagggagtcatcactattcaggacgggaagacattgctcaatgagttggatgttgttgaagggatgaagttggatagaggttacatatcaccatacttcatcacaaatcagaagaatcagaaatgtgaactggataacccactaattctgattcatgagaaaaagatctcaagcattaatgctgttgtgaaagcattggagttagctctgaagagacaaaggcccctcttaattgtggctgaagatgtggacaatgaagcactcgccactcttattttgaacaaactccgtgctggaatcaaggtttgtgccatcaaagcaccaggctttggtgaaaacaggaaagcttatttgcaagatcttgctattttaactggaggccaagtcataacagaagagcttggactgaacattgaaaatttggagttcgagatgctgggaacaagtaaagaggcaactatctctaaggatgatactgtcattcttgatggtgctggtgagaagaagtccatcgaggaacgatgcgaactgattagatcaaccattgaacagagcacatctgactatgacaaggagaagttgcaggaaagactagctaagctttcagggggtgttgctgtgttaaagattggaggagccagtgaagctgaggttggtgaaaagaaagatagagtaactgatgctttgaacgccacaaaggctgcagtggaggaaggaattgttccaggtggtggtgttgctcttctttatgcagcaagagaattggataatttgacaacagccaactttgaccagaagattggtgtacaaattattcagaatgctctgaagacgccagtacatacaatagcctctaacgcaggagtagagggtgctgtcgtggttggcaaattgttggatcaggacaaccttgatcttggatatgatgcggccaagggtgaatatgtagatatgataaaggcaggaatcatcgatccagtgaaagtgatcaggacagctttggtcgatgctgccagtgtctcgtctcttttgaccacaactgaagcagttgttgtcgagcttcctaaggacgagaaggaatctcctgcaatgggtggcggtatgggtggtggtatgggtggcatggacttctgattgaaaagccaaaaacagtaattgcagctgcttgacacatttggtttatagaacaaagcaaaaaaataaatttagatttatttcctattttgatgaatctttttacgatagaaaacgcgcctattgtatcaatagcaagagagacaagaccattgtgaattcatgtttttgtaggttcaaaatttgtagtcttcatttgaatacgcagcttaaatataggtccatttcagtgtaaaaaaaaaaaaaaa

SEQ ID NO: 567 - DNA, 1933 bp, Lycopersicon esculentum
actgttcgttgcacaattgatgagcaatgcttttttataatgccaactttgtacaaaaaagcaggcttaaacaatgtatcgttttgcagcaaatcttgcttctaaagccagtgttgcaagaaccagttcccaaaagattggtgggaggttgaattggagtagaaactatgctgcaaaggatatcagatttggagttgaagctagagctttgatgcttcaaggtgttgagcagcttgctgatgctgttaaagtcactatgggtccaaaggggcgtaatgtggtgattgaacaaagttggggtgcacccaaagtgacaaaagatggcgtgactgttgcaaaaagtattgaattcaaggacaagatacaaaatgttggtgctagccttgtaaaacaagtcgccaatgcaacaaatgatgttgctggtgatggtaccacttgtgcaacagttctcacccgagcaatatttgctgaaggatgcaagtcagtggcagctggtatgaatgcaatggaccttagacggggtattaccatggctgtagattctgttgtgacaaacctgaaaagcagagcacggatgatcagtacatctgaggaaattgcacaggttgggactatctctgcaaacggagaaagagtaattggcgacctcattgcaagggcaatggagaaagtaggcaaggagggagtcatcactattcaagacgggaagacattgctcaatgagttggatgttgttgaagggatgaagttggatagaggttacatatcaccatacttcatcacaaatcagaagaatcagaaatgtgaactggataacccactaattctgattcatgagaaaaagatctcaagcattaatgctgttgtgaaagcattggagttagctctgaagagacaaaggcccctcttaattgtggctgaagatgtggacaatgaagcactcgccactcttattttgaacaaactccgtgctggaatcaaggtttgtgccatcaaagcaccaggctttggtgaaaacaggaaagcttatttgcaagatcttgctattttaactggaggccaagtcataacagaagagcttggactgaacattgaaaatttggagttcgagatgctgggaacaagtaaagaggcaactatctctaaggatgatactgtcattcttgatggtgctggtgagaagaagtccatcgaggaacgatgcgaactgattagatcaaccattgaacagagcacatctgactatgacaaggagaagttgcaggaaagactagctaagctttcagggggtgttgctgtgttaaagattggaggagccagtgaagctgaggttggtgaaaagaaagatagagtaactgatgctttgaacgccacaaaggctgcagtggaggaaggaattgttccaggtggtggtgttgctcttctttatgcagcaagagaattggataatttgacagcagccaactttgaccagaagattggtgtacaaattattcagaatgctctgaagacgccagtacatacaatagcctctaacgcaggagtagagggtgctgtcgtggttggcaaattgttggatcaggacaaccttgatcttggatatgatgcggccaagggtgaatatgtagatatgataaaggcaggaatcatcgatccagtgaaagtgatcaggacagctttggtcgatgctgccagtgtctcgtctcttttgaccacaactgaagcagttgttgtcgagcttcctaaggacgagaaggaatctcctgcaatgggtggcggtatgggtggtggtatgggtggcatggacttctgattgaaaagccaaaaacagtaattgcagctgcacccagctttcttgtacaaagttggcattataagaaagcattgcttatcaatttgttgcaacgaacaggtcactatcagtcaaaataaa

SEQ ID NO: 568 - DNA, 2117 bp, Triticum aestivum
gctcttcctctcccttctcctccctctaaaatccgcctcccccttcccccattccctttcctcctccccaagaaacaaccgaagctcgcacatcatctcacctcggcgcctcgcccccctagcctctacgcacctcgactccggcgccatctcgctgcattcgccatgtaccgcgccgccgccagcctcgcctccaaggcccggctagccgggagcagcgcccgacaggtcgggagcaggctcgcctggagcaggaactatgccgccaaggacatcaggttcggcgtcgaggccagggccatgatgctcaagggtgtcgaagacctggcagatgcggtcaaagtgaccatgggtcccaaggggcgcactgtgatcattgagcaaagctttggtgccccaaaagtcacaaaggatggagtcaccgttgccaagagcattgaattcaaagacagagtcaagaacgtaggtgcaagccttgtaaaacaggttgctaatgcaacaaatgatactgctggagatggtacaacatgtgccactgttctgacaaaagcaatattcactgagggatgcaagtccgtagcagctggaatgaacgcaatggatctaagacgcggaatctcaatggcggttgatgatgtggtaacaaacctaaagggcatggccagaatgatcaacacgtcaaaggaaatagcacaggtgggtacaatatcagcaaatggcgaaagggaaattggtgagctcattgcaaaggctatggagaaggttggcaaagagggagttatcaccattgcggatggtaacactctatacaatgagcttgaagttgtggaaggcatgaagcttgacagaggttacatctctccatactttattaccaaccaaaagaaccagaaatgtgaactagatgatcccttaattttgatacatgataagaaagtatccaaccttcgctcattggtcaaagtgttggagtttgctctccagaagcaaaggcctctccttattgttgcagaagatctagaaagtgaagcacttggtacactaattcttaacaagcttcgcggaggcttcaaggtctgtgcgatcaaagctcctgggtttggagagaacaggaaatccaacttacaggaccttgccatccttactggtggagaagtcataactgaagaacttggaatgaaccttgagaactttgagccaaacatgctgggtacctgcaagaaggttaccatatctaaggatgatacagtcatccttgatggagcgggtgataagaaggccatcgaagagagagctgagctgctgacatcttcaattgagcaatgcacttctgactatgataaggaaaagatacaggagcgactggcaaagctttctggtggtgtcgcagtcctgaagattggtggagcaagtgaagcagaagttggtgagaagaaggacagagtgacagatgcgctaaatgctacaaaagctgcagtagaggagggtattgtaccaggtggtggtgttgcccttctttatgcgtcaaaggacttggataaattgcctacagcaaactttgaccaaaagattggtgtccagatcattcaaaatgctttgaagaccccagtacatacaattgctaccaatgcgggtgtagaaggggctgtcattgttggcaagctcttggagcaggaaaataccgacctgggctatgatgctgccaaaggcgaatatgtggatatggtgaaggctggtatcattgacccacttaaggtgatcagaacagcactggtggatgctgcaagtgtgtcgtctctgatgactaccacggaagccatcatcgttgagatccccaaggaagacaaggcggcacccgcaatgggaggcggcggcatgggagggatggatttctaacttgctcccaggctcatgtcaaaacaatgtgattagatggaacatctaggttagaactttttgtagcgcggatgtggattcatcgttatttactgtgggtgaatgaggctgtcacattttttgttctgctgcaagatgattttgcaacttgaatcatgtatgaacatggcgaacagagcctacagttgttaacaagcccgaaaaaaaaaaaaaaaaaaaaa

SEQ ID NO: 569 - DNA, 2101 bp, Zea mays
tccgcaagaaagaaagcgaagcaactctccgccgcctccattcctccacagcccacaccaaccaaacctctcgccgacaacagcctcggtccccgcgccaccatccgcaatcatgtaccgcgcggccgttagcctcgcctccaaggcgcggcaagccgggagcagctccgccgctcgccaggttggaagcaggcttgcctggagcaggaactatgctgccaaggacatcaagtttggtgttgaggcccgtgctctgatgttgaggggtgttgaggagttggcagacgctgtcaaagtgacaatgggtcctaaggggcgcaatgtggttattgagcaaagcttcggtgcaccgaaagtcacaaaggatggtgtgactgttgcgaagagcattgaatttaaggatagagtaaagaatgttggtgcgagccttgtgaaacaggttgctaatgcaactaatgacactgctggtgatggtaccacatgtgctactgttttgacaaaagcaatatttactgaggggtgcaaatctgttgcggctggaatgaatgcaatggatttaaggcgtggaatctcaatggctgttgatgctgttgtgaccaatctgaagggcatggccagaatgattagcacttcagaagaaattgcacaggtgggtacaatatcagcaaatggagaaagggaaattggtgagcttattgccaaggctatggagaaggttggcaaagagggtgtgatcactattgcggatggcaacaccctttataatgagcttgaagttgtggagggtatgaaacttgacagaggttacatctctccgtacttcattaccaactcaaaagcccagaaatgtgaactggaagacccattgatcttaattcatgacaagaaagtgacaaatatgcatgctgtggttaaggttttagaaatggctctaaagaaacaaaggcctctactgattgttgcagaagatgtggaaagtgaagcattaggtactctgattattaacaagcttcgtgcaggcatcaaggtctgtgctgtcaaagctcctggttttggggaaaacaggaaggcaaacttacaggacctcgctatccttaccggaggagaggtaataactgaagagctaggaatgaaccttgagaatgttgagcctcacatgctgggttcatgcaaaaaggtgactgtctctaaggatgacactgttattcttgatggcgctggagacaaaaagtctattgaagagagggcagaccagattagatcagcagttgagaacagcacttcagattatgacaaggaaaagctccaggaacggttggcaaagctctctggaggtgttgctgttctgaagattggaggagccagcgaagcagaagttggtgagaagaaggatagagtgacagatgcactgaatgctactaaagctgctgttgaagagggcattgtaccaggtggtggtgttgctcttctctatgcatcgaaggagctcgataagttgcagacagcaaattttgatcagaagattggtgtgcaaatcattcagaatgctttgaagacacctgtacacaccattgcctccaatgctggggtggagggagcagtagttgtgggcaagcttttggagcaaggaaacactgaccttggttatgatgctgctaaagacgaatacgttgacatggtgaaggctggtatcattgatccgctaaaggtcatcagaactgcattggtggatgctgctagtgtgtcgtccctgatgaccaccacggaatccataattgtagagatccccaaggaagaggcaccggctccagcaatgggtggcatgggtggaatggattactaagtgtcaagcacacccccgatacaacaacatcaaagcagagatgacgaggtggttgtcaggaggatacaattttgaggttgcggacgtaggacctcaatatctccaagcaatagtggggggataataaacatgaccagtagttgtttgagatctgaacctgtagatcaagattggattttgaccccttgtgctgaaccaagtgtagtctgattattacacattttttggttgagtaaaatcggattgccgttctgtttt

SEQ ID NO: 570 - DNA, 3095 bp, Zea mays
tcgagtgcgcacacgagcagacccccgcagacagccaggcacactcgcgcgaccatgtaccgggcggcggctgtcatctcgaggtcctcatcagcactgcggaggcagctcgcgcggggcgtggccggggagctgccgcgtctgttggcgcgagggtatgcggccacggcgaaggaggtgtccttcggcgttggcgcccgcgccgccatgctgcagggcgtcaacgacctcgccgacgccgtcaaggtcaccatgggccccaaggggcgcactgtgatcatcgaggggtcccataaaggtcccaaggtcacgaaggacggggtcactgttgcaaaaagcgtggagttcgaggatagcgcgaagaatgttggggcgaatctggtgaagcaagttgctgatgctacgaacaaagctgcaggggatggtaccacctgtgcaactgtgcttacacaggcaattcttactgaaggatgcaaggccgtggcagccggtgtcaacgttatggacttgcggaatggtataaacaaggcaataaatgctatcactgctcacctcaaaagtaaagcgtggaagattaattctccagaagaaattaaccaggtagcaaccatttctgcaaacggtgaaaaggaaattggagatctaatatcaaaagccatggaaaaagttggaaaggatggagtcattactattgttgatggcaaaacattggacaatgagcttgaagcagtacagggaatgaagctgtccagaggatacatatctccttactttgtgactgatcaaaagactcagaaatgtgagatggagaaccctcttattcttatccatgacaagaaaatctcaaacatggattctctccttccagcattagaaatttctatcaagaatcgcaagcctcttctcattgttgctgaggatgttgaaggagatgctctgtcaatgcttgtactgaacaagcatcgtgctggactcaaggtatgtgctgtcaaagctcctggatttggtgaaaatagaaggcacaatctagatgacatggctgtgatgactggaggagaggttattagcgaggaacgcggtcttgatcttggcaaagttcaattacaaatgcttggcactgctaaaaaggtaactgtatcccttgatgatactatcatcctagatggtggaggtgacaaacagcagatagatgagaggtgccaacagcttagagaatcaattgacacaagcactgctgtattcgacaaagaaaaggcccaagagcgtttatctaagttatctggaggtgttgctgtactcaagattggtggagctagtgaagctgaagttggtgagaaaaaagatagggtgacagatgctctaaatgctgcaagggctgctgtggaggagggcattgtgccaggtggtggagttgcccttctttatgccaccaaggagcttgacaagattagcacagcaaacgaggacgaaaagattggagttcaaattatcaagaattctttgaaggctcccttgatgaccatagctgcaaatgctggcattgatggagctatagtcatagggaagctgattgaacaagaggacctcagtttgggctatgatgcagcaaaaggggagtacgtagacatgatcaaggccggcatcatcgatcccgtgaaggtgatccgcaccgcacttcaagacgctgcaagtgtttccctgctgatggcaaccacggaggccgctgtctccgagctcccggcaaccaagtccagaatagccagccgtatgccgcagatgagcgggatggacttctgaggaaattcaggcgccgtgtatgatgctgatctgtgacctgtaaggctaggaattgggaggttggggacgaactttgtttccctagcggatagtcggatacgtctacggagttcattcgaaacgaggtgcagaactgtcaccgagttgcagtttttgatgcagtgcggcgttcgatggtggggtaataaagctggactgatagcgccttccattttgaatgctctgtctgaggcatcgtttggtgccgtcgaagcagctgaattccctttgtacgagcgcagctgagtttctttctgtcaccgtctcgagttcaaccttcacacgacacgagctacatttttacccgtctggtttttccgtagctgagcacagagcaacagcacatgtcagcaaatttgacacctgccgtgccgtccctgaaaggataccaggaggcgaaaacggctgtaataatatggatgaaaaggtaaaactccgtttgcttaaacgcgcagagtttattcacgtcgaagaattacggttagaagacgaagaaatcacaggagagtagagactttgggaaggtagattgctgctcgcttgaagctcctacgctgtcttggcctcgtcgggcggctggatgaagcgggaaacttctccgttcatcaccctccatgggccccagtagaacttgggcggcatgatcggcaccgcctcgccagggtgatcctcccagatttttcgcaaaaaaaaagagagtcagtttagccttgcctagcgagctcaatgaagcgcacggcccgaattctcgaaatgcttcgaacaaatctgatgctttcggtgcatggcaacagaacctctctccagatgcaatgagcagacagacgaattcgggcaccgagatcatgtgaggggccttggaaaatttcatcaacacagagtcccgatgtacgagtcaccacgccactcaagctggccggagatccgctaagcattccgacgagcaccgatgggcgctgcagtgcgtgtggccggcgggagaggagcgagggcaagcggggaatggaaatcccaggcgctgaggttggccgaccttgtagagctgctcggtgacggcggccccgaggacgccggtgtagaaggcggcgacgtaggtgccgacgagtggcgcgacggagcgcgccgggcggtggggctccaccataccccacagcaccgtcttctcgcacctgtggaactgccggtccgcgtaccacctccagaaccggctcgacatcgccgccacctcctcctctttctcctcctcccttcccagtccc

SEQ ID NO: 571 - protein, 155 aa, Allium cepa
MYRPALYAASKARSACISGKQVGSRLSWRRNYAAKDIRFGVDARALMLKGVEELADAVKVTMGPKGRNVVIEQSFGAPKVTKDGVTVAKSIEFKDRVKNMGASLVKQVANATNDSAGDGTTCATVLTKAIFSEGCKSVAAGMNAMDLRRGITMAG

SEQ ID NO: 572 - protein, 572 aa, Arabidopsis thaliana
MYRVLSKLSSSIGSSTSRKLVSGRIISSRNYAAKDISFGIGARAAMLQGVSEVAEAVKVTMGPKGRNVIIESSYGGPKITKDGVTVAKSISFQAKAKNIGAELVKQVASATNKVAGDGTTCATVLTQAILIEGCKSVAAGVNVMDLRVGINMAIAAVVSDLKSRAVMISTPEEITQVATISANGEREIGELIARAMEKVGKEGVITVADGNTLDNELEVVEGMKLARGYISPYFITDEKTQKCELENPIILIHEKKISDINSLLKVLEAAVKSSRPLLIVAEDVESDALAMLILNKHHGGLKVCAIKAPGFGDNRKASLDDLAVLTGAEVISEERGLSLEKIRPELLGTAKKVTVTRDDTIILHGGGDKKLIEERCEELRSANEKSTSTFDQEKTQERLSKLSGGVAVFKVGGASESEVGERKDRVTDALNATRAAVEEGIIPGGGVALLYATKALDNLQTENEDQRRGVQIVQNALKAPAFTIAANAGYDGSLVVGKLLEQDDCNFGFDAAKGKYVDMVKAGIIDPVKVIRTALTDAASVSLLLTTTEASVLVKADENTPNHVPDMASMGM

SEQ ID NO: 573 - protein, 585 aa, Arabidopsis thaliana
MYRLVSNVASKARIARKCTSQIGSRLNSTRNYAAKDIRFGVEARALMLRGVEDLADAVKVTMGPKGRNVIIEQSWGAPKVTKDGVTVAKSIEFKDRIKNVGASLVKQVANATNDVAGDGTTCATVLTRAIFTEGCKSVAAGMNAMDLRRGIKLAVDTVVTNLQSRARMISTSEEIAQVGTISANGDREIGELIAKAMETVGKEGVITIQDGKTLFNELEVVEGMKIDRGYISPYFITNPKTQKCELEDPLILIHEKKISNINAMVKVLELALKKQRPLLIVAEDVESDALATLILNKLRANIKVCAVKAPGFGENRKANLHDLAALTGAQVITEELGMNLDNIDLSMFGNCKKVTVSKDDTVVLDGAGDKQAIGERCEQIRSMVEASTSDYDKEKLQERLAKLSGGVAVLKIGGASETEVSEKKDRVTDALNATKAAVEEGIVPGGGVALLYASKELEKLSTANFDQKIGVQIIQNALKTPVYTIASNAGVEGAVVVGKLLEQDNPDLGYDAAKGEYVDMIKAGIIDPLKVIRTALVDAASVSSLLTTTEAVVTEIPTKEVASPGMGGGGMGGMGGMGGMGGMGF

SEQ ID NO: 574 - protein, 577 aa, Arabidopsis thaliana
MYRFASNLASKARIAQNARQVSSRMSWSRNYAAKEIKFGVEARALMLKGVEDLADAVKVTMGPKGRNVVIEQSWGAPKVTKDGVTVAKSIEFKDKIKNVGASLVKQVANATNDVAGDGTTCATVLTRAIFAEGCKSVAAGMNAMDLRRGISMAVDAVVTNLKSKARMISTSEEIAQVGTISANGEREIGELIAKAMEKVGKEGVITIQDGKTLFNELEVVEGMKLDRGYTSPYFITNQKTQKCELDDPLILIHEKKISSINSIVKVLELALKRQRPLLIVSEDVESDALATLILNKLRAGIKVCAIKAPGFGENRKANLQDLAALTGGEVITDELGMNLEKVDLSMLGTCKKVTVSKDDTVILDGAGDKKGIEERCEQIRSAIELSTSDYDKEKLQERLAKLSGGVAVLKIGGASEAEVGEKKDRVTDALNATKAAVEEGILPGGGVALLYAARELEKLPTANFDQKIGVQIIQNALKTPVYTIASNAGVEGAVIVGKLLEQDNPDLGYDAAKGEYVDMVKAGIIDPLKVIRTALVDAASVSSLLTTTEAVVVDLPKDESESGAAGAGMGGMGGMDY

SEQ ID NO: 575 - protein, 574 aa, Medicago truncatula
MYRFASSLASKARIARSNANQIGSRVAWSRNYAAKEIKFGVEARALMLKGVEELAEAVKVTMGPKGRNVVIEQSFGAPKVTKDGVTVAKSIEFKDKVKNIGASLVKQVANATNDVAGDGTTCATVLTRAIFTEGCKSVAAGMNAMDLRRGINMAVDAVVTNLKSRARMISTSEEIAQVGTISANGDREIGELIAKAMEKVGKEGVITIADGKTLQNELEVVEGMKLDRGYISPYFITNQKNQKCELEDPLIIIHEKKISNINSIVKVLELALKKQRPLLIVAEDVESDALATLILNKLRAGIKVCAIKAPGFGENRKSGLQDLAVLTGGQLITEELGMNLEKVDLEMFGSCKKITISKDDTVILDGAGDKKSIEERCEQIRSAVENSTSDYDKEKLQERLAKLSGGVAVLKIGGASEAEVGEKKDRVTDALNATKAAVEEGIVPGGGVALLYASNELSKLPTANFDQKIGVQIIQNALKTPVHTIASNAGVEGAVVVGKLLEQDNPDLGYDAAKGEYVDMVKSGIIDPLKVIRTALVDAASVSSLMTTTEAVVSELPKEDKDTPAMPGMGGMDY

SEQ ID NO: 576 - protein, 576 aa, Medicago truncatula
MYRFASSLASKARIARNNVQQVGSRVAWNRNYAAKEIKFGVEARALMLKGVEDLAEAVKVTMGPKGRNVVIEQSFGAPKVTKDGVTVAKSIEFKCKVKNIGASLVKQVANATNDVAGDGTTCATILTRAIFSEGCKSVAAGMNAMDLRRGINMAVDAVVTSLKSRARMISTSEEIAQVGTISANGDREIGELIAKAMEKVGKEGVITIADGKTLHNELEVVEGMKLDRGYISPYFITNQKNQKCELEDPLVIIHEKKISSLNAIVKVLELALKKQRPLLIVAEDIESDALATLILNKLRAGIKVCAIKAPGFGENRKSGLQDLAVLTGGQLITEDLGHNLEKVDLEMFGSCKKITISKDDTVILDGAGDKKAIEERCEQIRSAVENSTSDYDRDKLQERLAKLSGGVAVLKIGGASEAEVGEKKDRVTDALNATKAAVEEGIVPGGGVALLYASNELSKLSTANFDQKIGVQIIQNALKTPVHTIASNAGVEGAVVVGKLLEQDNPDLGYDAAKGEYVDMVKAGIIDPLKVIRTALVDAASVSSLMTTTEAIVSDLPSEDKDGPAMPAGMGGMGGY

SEQ ID NO: 577 - protein, 581 aa, Oryza sativa
MYRAAAAAASSISRSSSALRKQLSRGGCGEQRLWARGYAAKEVAFGVGARAALLQGVNDLADAVKVTMGPKGRNVIIERSHRAPKVTKDGVTVAKSIEFEDSAKNVGANLVKQVAEATNKVAGDGTTCATVLTQAILTEGCKAVAAGVNVMDLRNGINKAISSITTHLKSKAWIINSSEEINQVATISANGEKEIGDLISKAMEKVGKDGVITITDGKTLDNELEAVQGMKLSRGYISPYFVTDQKTQKCEMENPLILIHDKKISTMNSLLPVLEMSIKNRRPLLIIAEDVEGEALSMLVLNKHRAGLKICAVKAPGFGENRRANLDDVAVLTGGEVVSEDQGLDLGKVELQMLGTAKKVTVSLDDTIILDGGGDKQQIEERCQQLRESMDKSTAVFDKEKAQERLSKLSGGVAVLKIGGASEVEVGEKKDRVTDALHAARAAVEEGIVPGGGVALLYATKELDKIITANEDEKIGVQIIKNALKAPLMTIAANAGIDGGVVIGKLIEQDNLNMGYDAARGEYVDMIKAGIIDPVKVIRTALQDASSVSLLMTTTEAAVAEPPAAKARMASRMPQMSGMDF

SEQ ID NO: 578 - protein, 634 aa, Oryza sativa
MLLEPPRVFSSLIKSPRPPLFPPPQEKKRLHSSTSSPPPLTSPPLPSLLLPSPRSLLGSAMYRAAASLASKARQAGSSARQVGSRLALSRNYAAKDIKFGVEARALMLRGVEELADAVKVTMGPKGRNVVIEQSYGSPKVTKDGVTVAKSIEFKDRVKNVGASLVKQVANATNDTAGDGTTCATVLTKAIFTEGCKSVAAGMNAMDLRRGISMAVDAVVTNLKGMARMISTSEEIAQVGTISANGEREIGELIAKAMEKVGKEGVITIADGNTLYNELEVVEGMKLDRGYISPYFVTNPKTQKCELDDPLILIHDKKVSNLHAVVKVLELALKKQRPLLIVAEDVESEALGTLIINKLRAGIKVCAVKAPGFGENRKANLQDLAILTGGEVITEELGMNLEKFEPQMLGTCKKVTVSKDDTVILDGAGDKKSIEERAEQIRSAIELSTSDYDKEKLQERLAKLSGGVAVLKIGGASEAEVGEKKDRVTDALNATKAAVEEGIVPGGGVALLYASKELDKLPTANFDQKIGVQIIQNALKTPVHTIASNAGVEGAVVVGKLLEQDNTDLGYDAAKGEYVDMVKAGIIDPLKVIRTALVDAASVSSLMTTTESIIVEIPKEEKEAPAMGGMGGMDY

SEQ ID NO: 579 - protein, 577 aa, Oryza sativa
MYRAAASLASKARQAGSSARQIGSRLALHRNYAAKDIKFGVEARALMLRGVEELADAVKVTMGPKGRTVVIEQSFGAPKVTKDGVTVAKSIEFSNRVKNVGASLVKQVANATNDTAGDGTTCATVLTKAIFAEGCKSVAAGMNAMDLRRGISMAVDEVVTNLKGMARMISTSEEIAQVGTISANGEREIGELIAKAMEKVGKEGVITITDGNTLYNELEVVEGMKLDRGYISPYFITNQKNQKCELDDPLILIHDKKVSNLHAVVKVLELALKKQRPLLIVAEDVESEALGTLIINKLRAGIKVCAVKAPGFGESRKANLQDLAILTGGEVITEELGMNLENFEPQMLGTCKKVTVSKDDTVILDGAGDKKAIEERAEQLRSAIELSTSDYDKEKLQERLAKLSGGVAVLKIGGASEAEVGEKKDRVTDALNATKAAVEEGIVPGGGVALLYASKDLDKLQTANFDQKIGVQIIQNALKTPVHTIASNAGVEGSVIIGKLLEQDNTDLGYDAAKGEYVDMVKSGIIDPLKVIRTALVDAASVSSLMTTTESIIVEIPKEEEAAAAAPAMGGMGGMGF

SEQ ID NO: 580 - protein, 578 aa, Physcomitrella patens
MYRAAAALASRVNRGRSLVQNFSKLQSTRHFSAKDIRFGVEARALMLQGVEQLADAVQVTMGPKGRTVIIEQSFGSPKVTKDGVTVAKAIEFKDRLQNVGASLVKSVASSTNDVAGDGTTCATVLTRAIFVEGCKSVAAGMNAMDLRRGISVAVDAVVSYLKSQAKMISTSEEIAQVGTISANGDREIGDLLARAMEKVGKEGVITVSDGKTLFNELEVVEGMKLDRGYISPYFITNSKTQKVEFENPVILIHEKKINSLQAILPVLELVVKDQRPLLIVAEDVESEALATLIVNKLRGGVKVCAIKAPGFGENRKSLMQDLAVLTGGQLITEDMGLKLENITPDMLGHCKKVTVSKDDTIILDGGGNKAILEDRTEQIREAISTATSDYDKEKLQERLAKLSGGVAVLKIGGASEVEVSEKKDRVTDALNATKAAVEEGIVPGGGVALLYASRELDNVQTSNFDQKVGVQIIQNALKMPAYTIARNAGVEGAVVVGKLLEEANLNIGYDAAKAEYVDMVKAGIIDPVKVIRTALVDAASVASLLTTTEAIVADFPKDDEAMPGMGGMGGMGGMGGMY

SEQ ID NO: 581 - protein, 580 aa, Physcomitrella patens
MYRAAATLSARINRGRALVQNFNKLQSTRNFSAKDIRFGVEARALMLQGVEQLADAVQVTMGPKGRTVVIEQSFGSPKVTKDGVTVAKAIEFKDRLQNVGASLVKSVASSTNDVAGDGTTCATVLTRAIFVEGCKSVAAGMNAMDLRRGINLAVDSVVSHLKSQAKMISTSEEIAQVGTISANGDSEIGDLLARAMEKVGKEGVITVSDGKTLFNELEVVEGMKLDRGYISPYFITNAKTQKVELENPVILIHEKKINSLQAILPVLELVVRDQRPLLIVAEDVESEALATLIVNKLRGGVKVCAIKSPGFGENRKALMQDLAVLTGGQLISEDLGFKLEKVTPDMLGKCKKVTVSKDDTIILDGGGDKAALEERTEQIREAISAATSDYDKEKLQERLAKLSGGVAVLKIGGASEVEVNEKKDRVTDALNATKAAVEEGIVPGGGVALLYASRELEKVQTANFDQKIGVQIIQNALRMPAYTIARNAGVEGAVVVGKLMEQTNMSIGYDAAKAEYVDMVKAGIIDPVKVIRTALVDAASVASLMTTTEAVIADFPKDDKEAMPGMGGGMGGMGGMGGMY

SEQ ID NO: 582 - protein, 575 aa, Physcomitrella patens
MYRVAAALASRVSRGQSLVQACRLQSARKFSGKDIRFGVEARALMLQGVEQLADAVQVTMGPKGRTVIIEQSFGSPKVTKDGVTVAKSIEFKDRLKNVGASLVKSVANSTNDVAGDGTTAATVLTRAIFAEGCKSVAAGMNAMDLRRGINLAVEAVVAHLKSQAKMISTSEEIAQVGTISANGDREIGDLLARAMEKVGKEGVITVADGKTLFNELEVVEGMKLDRGYISPYFITNAKTQKVELENPVILIHEKKINSLQSILPVLELVVKDQRPLLIVAEDVESEALATLIVNKLRGGVCAIKAPGFGENRKALMQDLAVITGGQLISEDLGFKLEKITPVMLGSSKKVTVSKDDTIILDGGGDKTIIEDRIETIREAINSATSDYDKEKLQERLAKLSGGVAVLKIGGASEVEVSEKKDRVTDALNATKAAVEEGIVPGGGVALLYASRELDKIQTANFDQKVGVQIIQNALKMPAYTIAQNAGVEGAVVVGKLLEQTNMSIGYDAAKAEYVDMVKAGIIDPVKVIRTSLVDAASVASLMTTTESVVADFNKAEDKEMMGGMGGGMGGMGGMY

SEQ ID NO: 583 - protein, 580 aa, Physcomitrella patens
MFRAAAALAAHVRFRPLVRNFDHFQLVRWFSAKDIRFGVEARALMLQGVEQLADAVQVTMGPKGRTVVLEQSYGSPKITKDGVTVAKSIEFKDKLKNVGASLVKSVANATNDVAGDGTTAATVLARAIFTEGCKSVAAGMNAMDLRRGITLAVDAVVAHLKSQAKMISTSEEIAQVGTISANGDREIGDLLARAMEKVGKEGVITVSDGKTLFNELEVVEGMKLDRGYISPYFITNNKTQKVELENPVILIHEKKITGLQSILPVLELVVREQRPLLIVAEDVESEALATLIVNKIRGGVKVCAIKAPGFGDSRKSILQDLAVLTGGQLISEDLGLKLEKIELDMLGAAKKVTVSKDDTIILDGAGDKAIIEERLEQIRDSLGQTTSEYDKEKLEERLAKLSGGVAVLKIGGTSEVEVNEKKDRVTDALNATKAAVEEGIVPGGGVALLYASKELYKIPTNNFDQRIGVQIIQNALKMPAYTIAHNAGLEGAVVVGKLLDQSNLNIGYDAAKGEYVDMVKAGIIDPVKVIRTAFVDAASVASLMTTTEAVVAESNKEEKDLVPSTGGGISGLGGMGGMYG

SEQ ID NO: 584 - protein, 341 aa, Populus trichocarpa
MHRFTSSLASKARIARSSTNQIGSRLSWSRNYAAKDIRFGVEARAGMLKGVEELADAVKVTMGPKGRNVVIEQSYGAPKVTKDGVTVAKSIEFKDKVKNVGASLVKQVANATNDAAGDGTTCATVLTQAIFTEGCKSVAAGMNAMDLRRGISMAVESVVTNLKSRARMISTSEEIAQVGTISANGEREIGELIAKAMEKVGKEGVITIQDGKTLSNELEVVEGMKLDRGYISPYFITDQKTQKCELDDPLILIHDKKVSSLHAVVKVLELALKRQRPLLIVAEDVESEALATLILNKLRAGIKVCSIKAPGFGENRKAILQDLAALTGGEQVLNFCFAGYN

SEQ ID NO: 585 - protein, 550 aa, Populus trichocarpa
MHRFTSSLASKARIARSTTKQIGSRLSWSRNYAAKDIRFGVEARAVMLKGVEELADAVKVTMGPKGRNVVIEQSFGAPKVTKDGVTVAKSIEFKDKVKNVGASLVKQVANATNDAAGDGTTCATVLTRAIFAEGCKSVAAGMNAMDLRREIAQVGTISANGEREIGELIAKAMEKVGKEGVITIQDGKTLSNELEVVEGLKLDRGYISPYFITDQKTQKCELDDPLILIHDKKVSNLHAVVKVLELALKRQRPLLIVAEDVESEALATLILNKLRAGIKVCAIKAPGFGENRKATLQDLAVLTGAEVITEELGLNLEKVDLDMLGSCKKVTVSKDDTVILDGAGDKKSIEERCEQIRSAVESSTSDYDKEKLHERLAKLSGGVAVLKIGGASEAEVGEKKDRVTDALNATKAAVEEGIVPGGGAALLYASKELDKLQTANFDQKIGVQIIQNALKTPVHTIATNAGVEGAVVVGKLLEQDNPDLGYDAAKDEYVDMVKAGIIDPLKVIRTALVDAASVSSLMTTTEAVITELPKDENDAPAMGPGMGMDY

SEQ ID NO: 586 - protein, 247 aa, Populus trichocarpa
MEQLIILYCASFVFLSFHSSSASKKQLSSRVTYSRSYVAKDINFGVGARAAMLQGVNEVAEAVKVTMGPKGRHVIIEKSKDGVTVAKSIKFKEKAKSVGADLVKQVANATNTATGDGDLSTSCTTCATVLTQAILVEGCKSVSAGVNVMDLRSGINIAVGGVLSDLKKRALMISTPEEITLVATISANGEREIGEMIARAMGKAGKHGVITVTDGNTLDNELEVVEGMKLARGYISPYFITDQKTQK

SEQ ID NO: 587 - protein, 575 aa, Populus trichocarpa
MYRFASGLASKASGVAGNNAKQIGSRLAWRRNYAAKDIKFGVEARALMLRGVEELADAVQVTMGPKGRNVVLEQSWGAPKVTKDGVTVAKSIEFQDRVKNIGASLVKQVANATNDVAGDGTTCATVLTRAIFAEGCKSVAAGMNAMDLRRGISMAVEAVVTSLKSRARMISTSEEIAQVGTISANGEREIGELIAKAMEKVGKEGVITISDGKTMDNELEVVEGMKLDRGYISPYFITNDKNQKCELEDPLILIHEKKISSMSSTVKVLELALKRQRPLLIVAEDLEGEVLATLILNKLRAGIKVCAIKAPGFGENRKASLQDLSILTGGQVITEELGLNLDNVGLEMLGSCKKVTVSKDDTIILDGLGDKKTIEERCEQLRSAIGTSTSDYDKEKLQERLAKLSGGVAVLKIGGASEAEVGEKKDRVTDALNATKAAVEEGIVPGGGVALLYASKELDKLHTANFDQKIGVQIIQNALKTPVHTIASNAGVEGAVVVGKLLEQDNPDLGYDAAKGEYVDMVKSGIIDPLKVIRTALVDAASVSSLMTTTEAIVYELPKVEKETPASNGMSGMGF

SEQ ID NO: 588 - protein, 573 aa, Solanum lycopersicum
MFRAAAAVASSIRFSTSRKLVSSRIISSRNYAAKDISFGSHARLAMLQGVNELAEAVKVTMGPKGRNVIIEKSPGNPKVTKDGVTVAKSINFKEKAKNVGADLVKQVANATNSVAGDGTTCATVLTQAIFTEGCKAVAAGVSVMDLRNGINMAIDAVVADLKSRAVMISTPEEITQVGTISANGEREIGEIIARAMEKVGKEGVITVADGNTLDNDLEVVEGMKLGRGYISPYFVTDEKTQKCELENPLILIHDKKISDLNSLVRILELALKRRSPLLIVAEDVESDALAMLILNKHRAGIKVCAIKAPGFGDNRRANLEDLAVLTGGEVISEERGLDLSKVQFDMLGTAKKVTVSLDDTLVLHGGGDKKLIEERCEQLRIAKEKSSAMFDKEKAQERLSKLSGGVAVFKVGGASEAEVGERKDRVTDALNATRAAVEEGIVPGGGVALLYATKCLKGLQTANDGQKRGVEIIENALKAPTFTIASNAGADGALVVGKLLEQDDLNLGCDAAKGTYLHMVKAGIIDPVKVVRTALMDAASVSLLLTTAEAAIVDRQGEENPLANRMPNMGGMY

SEQ ID NO: 589 - protein, 573 aa, Solanum lycopersicum
MYRFAAKLASKSRVARSSTQQVGSRLNWSRNYAAKDIKFGVEARGIMLQGVEQLADAVKVTMGPKGRNVVIEQSWGAPKVTKDGVTVAKSIEFKDKIKNVGASLVKQVANATNDAAGDGTTCATVLTRAIFAEGCKSVAAGMNAMDLRRGITMAVDAVVTNLKSRARMISTSEEIAQVGTISANGEREIGEIIARAMEQVGKEGVITIQDGKTLLNDLQVVEGMKLDRGYISPYFITNEKNQKCELDDPLILIHEKKISSINAIVKVLELALKRQRPLLIVSEDVESEALATLILNKLRAGIKVCAIKAPGFGENRKANLQDLAALTGGQVITEELGMNIENVELEMLGKCKKVTISKDDTVVLDGAGEKKAIEERCEQIRSAIELSTSDYDKEKLQERLARLSGGVAVLKVGGASEVEVGEKKDRVTDALNATKAAVEEGILPGGGVALLYASKELDSLPTANFDQKIGVQIIQNALKTPVYTIASNAGVEGSVVVGKLLEQDNPDLGYDAAKGEYVDMVKAGIIDPLKVIRTALVDAASVSSLLTTTEAVIVELPKDEKAAPAMPGGGMDY

SEQ ID NO: 590 - protein, 579 aa, Solanum lycopersicum
MYRFAANLASKASVARTSSQKIGGRLNWSRNYAAKDIRFGVEARALMLQGVEQLADAVKVTMGPKGRNVVIEQSWGAPKVTKDGVTVAKSIEFKDKIQNVGASLVKQVANATNDVAGDGTTCATVLTRAIFAEGCKSVAAGMNAMDLRRGITMAVDSVVTNLKSRARMISTSEEIAQVGTISANGERVIGDLIARAMEKVGKEGVITIQDGKTLLNELDVVEGMKLDRGYISPYFITNQKNQKCELDNPLILIHEKKISSINAVVKALELALKRQRPLLIVAEDVDNEALATLILNKLRAGIKVCAIKAPGFGENRKAYLQDLAILTGGQVITEELGLNIENLEFEMLGTSKEATISKDDTVILDGAGEKKSIEERCELIRSTIEQSTSDYDKEKLQERLAKLSGGVAVLKIGGASEAEVGEKKDRVTDALNATKAAVEEGIVPGGGVALLYAARELDNLTTANFDQKIGVQIIQNALKTPVHTIASNAGVEGAVVVGKLLDQDNLDLGYDAAKGEYVDMIKAGIIDPVKVIRTALVDAASVSSLLTTTEAVVVELPKDEKESPAMGGGMGGGMGGMDF

SEQ ID NO: 591 - protein, 579 aa, Lycopersicon esculentum
MYRFAANLASKASVARTSSQKIGGRLNWSRNYAAKDIRFGVEARALMLQGVEQLADAVKVTMGPKGRNVVIEQSWGAPKVTKDGVTVAKSIEFKDKIQNVGASLVKQVANATNDVAGDGTTCATVLTRAIFAEGCKSVAAGMNAMDLRRGITMAVDSVVTNLKSRARMISTSEEIAQVGTISANGERVIGDLIARAMEKVGKEGVITIQDGKTLLNELDVVEGMKLDRGYISPYFITNQKNQKCELDNPLILIHEKKISSINAVVKALELALKRQRPLLIVAEDVDNEALATLILNKLRAGIKVCAIKAPGFGENRKAYLQDLAILTGGQVITEELGLNIENLEFEMLGTSKEATISKDDTVILDGAGEKKSIEERCELIRSTIEQSTSDYDKEKLQERLAKLSGGVAVLKIGGASEAEVGEKKDRVTDALNATKAAVEEGIVPGGGVALLYAARELDNLTAANFDQKIGVQIIQNALKTPVHTIASNAGVEGAVVVGKLLDQDNLDLGYDAAKGEYVDMIKAGIIDPVKVIRTALVDAASVSSLLTTTEAVVVELPKDEKESPAMGGGMGGGMGGMDF

SEQ ID NO: 592 - protein, 576 aa, Triticum aestivum
MYRAAASLASKARLAGSSARQVGSRLAWSRNYAAKDIRFGVEARAMMLKGVEDLADAVKVTMGPKGRTVIIEQSFGAPKVTKDGVTVAKSIEFKDRVKNVGASLVKQVANATNDTAGDGTTCATVLTKAIFTEGCKSVAAGMNAMDLRRGISMAVDDVVTNLKGMARMINTSKEIAQVGTISANGEREIGELIAKAMEKVGKEGVITIADGNTLYNELEVVEGMKLDRGYISPYFITNQKNQKCELDDPLILIHDKKVSNLRSLVKVLEFALQKQRPLLIVAEDLESEALGTLILNKLRGGFKVCAIKAPGFGENRKSNLQDLAILTGGEVITEELGMNLENFEPNMLGTCKKVTISKDDTVILDGAGDKKAIEERAELLTSSIEQCTSDYDKEKIQERLAKLSGGVAVLKIGGASEAEVGEKKDRVTDALNATKAAVEEGIVPGGGVALLYASKDLDKLPTANFDQKIGVQIIQNALKTPVHTIATNAGVEGAVIVGKLLEQENTDLGYDAAKGEYVDMVKAGIIDPLKVIRTALVDAASVSSLMTTTEAIIVEIPKEDKAAPAMGGGGMGGMDF

SEQ ID NO: 593 - protein, 576 aa, Zea mays
MYRAAVSLASKARQAGSSSAARQVGSRLAWSRNYAAKDIKFGVEARALMLRGVEELADAVKVTMGPKGRNVVIEQSFGAPKVTKDGVTVAKSIEFKDRVKNVGASLVKQVANATNDTAGDGTTCATVLTKAIFTEGCKSVAAGMNAMDLRRGISMAVDAVVTNLKGMARMISTSEEIAQVGTISANGEREIGELIAKAMEKVGKEGVITIADGNTLYNELEVVEGMKLDRGYISPYFITNSKAQKCELEDPLILIHDKKVTNMHAVVKVLEMALKKQRPLLIVAEDVESEALGTLIINKLRAGIKVCAVKAPGFGENRKANLQDLAILTGGEVITEELGMNLENVEPHMLGSCKKVTVSKDDTVILDGAGDKKSIEERADQIRSAVENSTSDYDKEKLQERLAKLSGGVAVLKIGGASEAEVGEKKDRVTDALNATKAAVEEGIVPGGGVALLYASKELDKLQTANFDQKIGVQIIQNALKTPVHTIASNAGVEGAVVVGKLLEQGNTDLGYDAAKDEYVDMVKAGIIDPLKVIRTALVDAASVSSLMTTTESIIVEIPKEEAPAPAMGGMGGMDY

SEQ ID NO: 594 - protein, 580 aa, Zea mays
MYRAAAVISRSSSALRRQLARGVAGELPRLLARGYAATAKEVSFGVGARAAMLQGVNDLADAVKVTMGPKGRTVIIEGSHKGPKVTKDGVTVAKSVEFEDSAKNVGANLVKQVADATNKAAGDGTTCATVLTQAILTEGCKAVAAGVNVMDLRNGINKAINAITAHLKSKAWKINSPEEINQVATISANGEKEIGDLISKAMEKVGKDGVITIVDGKTLDNELEAVQGMKLSRGYISPYFVTDQKTQKCEMENPLILIHDKKISNMDSLLPALEISIKNRKPLLIVAEDVEGDALSMLVLNKHRAGLKVCAVKAPGFGENRRHNLDDMAVMTGGEVISEERGLDLGKVQLQMLGTAKKVTVSLDDTIILDGGGDKQQIDERCQQLRESIDTSTAVFDKEKAQERLSKLSGGVAVLKIGGASEAEVGEKKDRVTDALNAARAAVEEGIVPGGGVALLYATKELDKISTANEDEKIGVQIIKNSLKAPLMTIAANAGIDGAIVIGKLIEQEDLSLGYDAAKGEYVDMIKAGIIDPVKVIRTALQDAASVSLLMATTEAAVSELPATKSRIASRMPQMSGMDF

SEQ ID NO: 595 - protein, 607 aa, Populus trichocarpa
MASTFTAMSSAGTLAAPNARALDKKFAFSSNKLSSFASISASRFGRPQNVVLPRSRSLKVNAAKELHFNKDGSAIRKLQTGVNKLADLVGVTLGPKGRNVVLESKYGSPKIVNDGVTVAKEVELEDPVEDIGAKLVRQAAAKTNDLAGDGTTTSVVLAQGLIAEGVKVVAAGANPVLITRGIEKTTRALVNELKLMSKEVEDSELADVAAVSAGNNYEVGNMIAEAMSKVGRKGVVTLEEGKSADNSLYVVEGMQFDRGYISPYFVTDSEKMAVEYDNCKLLLVDKKITNARDLIAILEDAIKGGYPVVIVAEDIEQEALATLVVNKLRGALKIAALKAPGFGERKSQYLDDIAILTGGTVVREEVGLALDKVGSEVLGHASKVVLTKDTTTIVADGSTQEAVNKRVAQIKNLIEAAEQDYEKEKLNERIAKLSGGVAVIQVGAQTETELKEKKLRVEDALNATKAAVEEGIVVGGGCTLLRLASKVDAIKDSLENDEEKVGADIVKRALSYPLKLIAKNAGVNGSVVSEKVLASDNPKFGYNAATGNYEDLMAAGIIDPTKVVRCCLEHASSVAKTFLMSDCVVVEIKEPESVPAGNPMDNSGYGY

SEQ ID NO: 596 - protein, 17 aa, Artificial sequence
  motif 31
  VARIANT (4)..(4): / replace = "Val" / replace = "Leu"
  VARIANT (5)..(5): / replace = "Val"
  VARIANT (7)..(7): / replace = "His"
  VARIANT (9)..(9): / replace = "Ala" / replace = "Leu"
  VARIANT (11)..(11): / replace = "Asp" / replace = "Glu"
  VARIANT (13)..(13): / replace = "Thr" / replace = "Lys" / replace = "Gln"
  UNSURE (14)..(14): Xaa is any amino acid, preferably one of Ile, Ala, Ser, Gly, Gln or Thr
  VARIANT (15)..(15): / replace = "Leu"
  VARIANT (16)..(16): / replace = "Asp"
  VARIANT (17)..(17): / replace = "Asp"
DDTIILDGGGNKAXIEE

SEQ ID NO: 597 - protein, 11 aa, Artificial sequence
  motif 32
  VARIANT (1)..(1): / replace = "Ala"
  VARIANT (2)..(2): / replace = "Ala" / replace = "Asn" / replace = "Glu"
  VARIANT (4)..(4): / replace = "Glu" / replace = "Asp"
  VARIANT (5)..(5): / replace = "Gly"
  VARIANT (6)..(6): / replace = "Gln"
  VARIANT (7)..(7): / replace = "Arg"
  VARIANT (8)..(8): / replace = "Ile" / replace = "Arg"
  VARIANT (11)..(11): / replace = "Glu"
TSNFDEKVGVQ

SEQ ID NO: 598 - protein, 18 aa, Artificial sequence
  motif 33
  VARIANT (1)..(1): / replace = "Gln"
  UNSURE (2)..(2): Xaa is any amino acid, preferably one of Ala, Thr, Ser, Asp or Glu
  VARIANT (3)..(3): / replace = "Asp"
  UNSURE (4)..(4): Xaa can be any amino acid
  VARIANT (5)..(5): / replace = "Ser" / replace = "Asp"
  VARIANT (6)..(6): / replace = "Leu" / replace = "Phe" / replace = "Met"
  VARIANT (8)..(8): / replace = "Phe" / replace = "Cys"
  VARIANT (12)..(12): / replace = "Arg"
  VARIANT (13)..(13): / replace = "Gly" / replace = "Asp"
  VARIANT (14)..(14): / replace = "Lys" / replace = "Thr"
  VARIANT (16)..(16): / replace = "Leu"
  VARIANT (17)..(17): / replace = "His"
EXNXNIGYDAAKAEYVDM

SEQ ID NO: 599 - protein, 27 aa, Artificial sequence
  motif 34
  VARIANT (2)..(2): / replace = "Arg" / replace = "Lys"
  VARIANT (5)..(5): / replace = "Ser" / replace = "Asn"
  VARIANT (6)..(6): / replace = "Glu" / replace = "Asp"
  VARIANT (7)..(7): / replace = "Leu"
  VARIANT (9)..(9): / replace = "Glu"
  VARIANT (12)..(12): / replace = "Gln"
  VARIANT (21)..(21): / replace = "His" / replace = "Asn"
  VARIANT (23)..(23): / replace = "Ile"
  VARIANT (24)..(24): / replace = "Leu"
  UNSURE (26)..(26): Xaa is any amino acid, preferably one of Gln, Ser, Arg, Lys, or Gly, most preferably Gln
LQGVEQVADAVKVTMGPKGRTVVIEXS

SEQ ID NO: 600 - protein, 12 aa, Artificial sequence
  motif 35
  VARIANT (9)..(9): / replace = "Ser"
  VARIANT (10)..(10): / replace = "Val"
  VARIANT (11)..(11): / replace = "Ser" / replace = "Lys" / replace = "Asn"
KDGVTVAKAIEF

SEQ ID NO: 601 - protein, 16 aa, Artificial sequence
  motif 36
  VARIANT (1)..(1): / replace = "Gln"
  VARIANT (2)..(2): / replace = "Ser"
  VARIANT (3)..(3): / replace = "Val"
  VARIANT (6)..(6): / replace = "Glu" / replace = "Asp" / replace = "Asn"
  VARIANT (10)..(10): / replace = "Gln"
  VARIANT (13)..(13): / replace = "Asn" / replace = "Glu" / replace = "Asp"
  VARIANT (14)..(14): / replace = "Ala"
KNIGASLVKSVASSTN

SEQ ID NO: 602 - protein, 29 aa, Artificial sequence
  motif 37
  VARIANT (3)..(3): / replace = "Ala"
  VARIANT (6)..(6): / replace = "Ile"
  VARIANT (8)..(8): / replace = "Ala"
  VARIANT (9)..(9): / replace = "Lys"
  VARIANT (12)..(12): / replace = "Leu"
  UNSURE (13)..(13): Xaa is any amino acid, preferably one of Val, Thr, Ser, or Ile
  VARIANT (18)..(18): / replace = "Ala"
  VARIANT (20)..(20): / replace = "Ser"
  VARIANT (23)..(23): / replace = "Val"
  VARIANT (24)..(24): / replace = "Ser"
TTCATVLTRAIFXEGCKSVAAGMNAMDLR

SEQ ID NO: 603 - protein, 6 aa, Artificial sequence
  motif 38
TISANG

SEQ ID NO: 604 - protein, 14 aa, Artificial sequence
  motif 39
  VARIANT (3)..(3): / replace = "His" / replace = "Asp"
  VARIANT (8)..(8): / replace = "Ile"
  UNSURE (9)..(9): Xaa is any amino acid, preferably on of Ser, Ala, Gln, Thr, or Val
  VARIANT (12)..(12): / replace = "Asn"
  VARIANT (14)..(14): / replace = "Met"
GKEGVITVXDGKTL

SEQ ID NO: 605 - protein, 11 aa, Artificial sequence
  motif 40
  VARIANT (4)..(4): / replace = "Thr"
  VARIANT (9)..(9): / replace = "Ile"
  VARIANT (11)..(11): / replace = "Asp"
RGYISPYFVTN

SEQ ID NO: 606 - protein, 10 aa, Artificial sequence
  motif 41
  VARIANT (5)..(5): / replace = "Ile"
  VARIANT (6)..(6): / replace = "Ser"
  VARIANT (9)..(9): / replace = "Leu" / replace = "Ile"
  VARIANT (10)..(10): / replace = "Asp"
PLLIVAEDVE

SEQ ID NO: 607 - protein, 9 aa, Artificial sequence
  motif 42
  VARIANT (2)..(2): / replace = "Ser"
  VARIANT (7)..(7): / replace = "Asp"
  VARIANT (8)..(8): / replace = "Ser"
KAPGFGENR

SEQ ID NO: 608 - protein, 4 aa, Artificial sequence
  motif 43
GMGG

SEQ ID NO: 609 - DNA, 49 bp, Artificial sequence
  primer: prm13455
ggggacaagtttgtacaaaaaagcaggcttaaacaatgtaccgcgcggc

SEQ ID NO: 610 - DNA, 50 bp, Artificial sequence
  primer: prm13456
ggggaccactttgtacaagaaagctgggtttagtaatccattccacccat

SEQ ID NO: 611 - DNA, 1264 bp, Oryza sativa
tcgacgctactcaagtggtgggaggccaccgcatgttccaacgaagcgccaaagaaagccttgcagactctaatgctattagtcgcctaggatatttggaatgaaaggaaccgcagagtttttcagcaccaagagcttccggtggctagtctgatagccaaaattaaggaggatgccaaaacatgggtcttggcgggcgcgaaacaccttgataggtggcttaccttttaacatgttcgggccaaaggccttgagacggtaaagttttctatttgcgcttgcgcatgtacaattttattcctctattcaatgaaattggtggctcactggttcattaaaaaaaaaagaatctagcctgttcgggaagaagaggattttgttcgtgagagagagagagagagagagagagagagagagagagaaggaggaggaggattttcaggcttcgcattgcccaacctctgcttctgttggcccaagaagaatcccaggcgcccatgggctggcagtttaccacggacctacctagcctaccttagctatctaagcgggccgacctagtagccacgtgcctagtgtagattaaagttgccgggccagcaggaagccacgctgcaatggcatcttcccctgtccttcgcgtacgtgaaaacaaacccaggtaagcttagaatcttcttgcccgttggactgggacacccaccaatcccaccatgccccgatattcctccggtctcggttcatgtgatgtcctctcttgtgtgatcacggagcaagcattcttaaacggcaaaagaaaatcaccaacttgctcacgcagtcacgctgcaccgcgcgaagcgacgcccgataggccaagatcgcgagataaaataacaaccaatgatcataaggaaacaagcccgcgatgtgtcgtgtgcagcaatcttggtcatttgcgggatcgagtgcttcacagctaaccaaatattcggccgatgatttaacacattatcagcgtagatgtacgtacgatttgttaattaatctacgagccttgctagggcaggtgttctgccagccaatccagatcgccctcgtatgcacgctcacatgatggcagggcagggttcacatgagctctaacggtcgattaattaatcccggggctcgactataaatacctccctaatcccatgatcaaaaccatctcaagcagcctaatcatctccagctgatcaagagctcttaattagctagctagtgattagctgcgcttgtgatc

SEQ ID NO: 612 - DNA, 2194 bp, Oryza sativa; identical to SEQ ID NO: 85

SEQ ID NO: 613 - DNA, 56 bp, Artificial sequence
  primer: prm17901
ggggacaagtttgtacaaaaaagcaggcttaaacaatggttagagaaggtgaagaa

SEQ ID NO: 614 - DNA, 50 bp, Artificial sequence
  primer: prm17902
ggggaccactttgtacaagaaagctgggttatgatttttgcctatggtta

SEQ ID NO: 615 - protein, 19 aa, Artificial sequence
  motif 44
  VARIANT (1)..(1): / replace = "His" / replace = "Asn"
  VARIANT (2)..(2): / replace = "Asn" / replace = "Asp"
  VARIANT (3)..(3): / replace = "Leu" / replace = "Met"
  UNSURE (4)..(5): Xaa can be any naturally occurring amino acid
  VARIANT (6)..(6): / replace = "Leu"
  UNSURE (7)..(10): Xaa can be any naturally occurring amino acid
  VARIANT (11)..(11): / replace = "Tyr" / replace = "His" / replace = "Asn"
  UNSURE (12)..(13): Xaa can be any naturally occurring amino acid
  misc_feature (15)..(16): Xaa can be any naturally occurring amino acid
  UNSURE (18)..(18): Xaa can be any naturally occurring amino acid
  VARIANT (19)..(19): / replace = "Ser" / replace = "Asp"
DSVXXVXXXXFXXCXXTXN

SEQ ID NO: 616 - protein, 8 aa, Artificial sequence
  motif 45
  VARIANT (1)..(1): / replace = "Asp"
  UNSURE (2)..(3): Xaa can be any naturally occurring amino acid
  VARIANT (4)..(4): / replace = "Tyr"
  VARIANT (5)..(5): / replace = "Tyr" / replace = "Ile"
  UNSURE (6)..(6): Xaa can be any naturally occurring amino acid
  VARIANT (7)..(7): / replace = "Gly" / replace = "Cys"
  VARIANT (8)..(8): / replace = "Ala" / replace = "Ile" / replace = "Thr"
GXXFFXSG

SEQ ID NO: 617 - protein, 31 aa, Artificial sequence
  motif 46
  VARIANT (1)..(1): / replace = "Val"
  VARIANT (2)..(2): / replace = "Asp" / replace = "Ala" / replace = "Glu"
  UNSURE (3)..(5): Xaa can be any naturally occurring amino acid
  UNSURE (7)..(7): Xaa can be any naturally occurring amino acid
  VARIANT (8)..(8): / replace = "Ile" / replace = "Thr" / replace = "Leu" / replace = "Ala"
  UNSURE (9)..(14): Xaa can be any naturally occurring amino acid
  VARIANT (16)..(16): / replace = "Ser" / replace = "Pro" / replace = "Val"
  UNSURE (17)..(20): Xaa can be any naturally occurring amino acid
  VARIANT (21)..(21): / replace = "Leu"
  UNSURE (22)..(23): Xaa can be any naturally occurring amino acid
  VARIANT (24)..(24): / replace = "Asp" / replace = "Asn" / replace = "Ser"
  UNSURE (26)..(30): Xaa can be any naturally occurring amino acid
  VARIANT (31)..(31): / replace = "Tyr"
GGXXXWXVXXXXXXWAXXXXFXXGDXXXXXF

SEQ ID NO: 618 - protein, 32 aa, Artificial sequence
  motif 47
  VARIANT (1)..(1): / replace = "Val"
  VARIANT (2)..(2): / replace = "Asp" / replace = "Ala" / replace = "Glu"
  UNSURE (3)..(5): Xaa can be any naturally occurring amino acid
  misc_feature (7)..(7): Xaa can be any naturally occurring amino acid
  VARIANT (8)..(8): / replace = "Ile" / replace = "Thr" / replace = "Leu" / replace = "Ala"
  UNSURE (9)..(15): Xaa can be any naturally occurring amino acid
  VARIANT (17)..(17): / replace = "Ser" / replace = "Pro" / replace = "Val"
  UNSURE (18)..(21): Xaa can be any naturally occurring amino acid
  VARIANT (22)..(22): / replace = "Leu"
  UNSURE (23)..(24): Xaa can be any naturally occurring amino acid
  VARIANT (25)..(25): / replace = "Asp" / replace = "Asn" / replace = "Ser"
  UNSURE (27)..(31): Xaa can be any naturally occurring amino acid
  VARIANT (31)..(31): / replace = "Tur"
GGXXXWXVXXXXXXXWAXXXXFXXGDXXXXXF

SEQ ID NO: 619 - protein, 33 aa, Artificial sequence
  motif 48
  VARIANT (1)..(1): / replace = "Val"
  VARIANT (2)..(2): / replace = "Asp" / replace = "Ala" / replace = "Glu"
  UNSURE (3)..(5): Xaa can be any naturally occurring amino acid
  UNSURE (7)..(7): Xaa can be any naturally occurring amino acid
  VARIANT (8)..(8): / replace = "Ile" / replace = "Thr" / replace = "Leu" / replace = "Ala"
  UNSURE (9)..(16): Xaa can be any naturally occurring amino acid
  VARIANT (18)..(18): / replace = "Ser" / replace = "Pro" / replace = "Val"
  UNSURE (19)..(22): Xaa can be any naturally occurring amino acid
  VARIANT (23)..(23): / replace = "Leu"
  UNSURE (24)..(25): Xaa can be any naturally occurring amino acid
  VARIANT (26)..(26): / replace = "Asp" / replace = "Asn" / replace = "Ser"
  UNSURE (28)..(32): Xaa can be any naturally occurring amino acid
  VARIANT (33)..(33): / replace = "Tyr"
GGXXXWXVXXXXXXXXWAXXXXFXXGDXXXXXF

SEQ ID NO: 620 - protein, 34 aa, Artificial sequence
  motif 49
  VARIANT (1)..(1): / replace = "Val"
  VARIANT (2)..(2): / replace = "Asp" / replace = "Ala" / replace = "Glu"
  UNSURE (3)..(5): Xaa can be any naturally occurring amino acid
  UNSURE (7)..(7): Xaa can be any naturally occurring amino acid
  VARIANT (8)..(8): / replace = "Ile" / replace = "Thr" / replace = "Leu" / replace = "Ala"
  UNSURE (9)..(17): Xaa can be any naturally occurring amino acid
  VARIANT (19)..(19): / replace = "Ser" / replace = "Pro" / replace = "Val"
  UNSURE (20)..(23): Xaa can be any naturally occurring amino acid
  VARIANT (24)..(24): / replace = "Leu"
  UNSURE (25)..(26): Xaa can be any naturally occurring amino acid
  VARIANT (27)..(27): / replace = "Asp" / replace = "Asn" / replace = "Ser"
  UNSURE (29)..(33): Xaa can be any naturally occurring amino acid
  VARIANT (34)..(34): / replace = "Tyr"
GGXXXWXVXXXXXXXXXWAXXXXFXXGDXXXXXF

SEQ ID NO: 621 - protein, 35 aa, Artificial sequence
  motif 50
  VARIANT (1)..(1): / replace = "Val"
  VARIANT (2)..(2): / replace = "Asp" / replace = "Ala" / replace = "Glu"
  UNSURE (3)..(5): Xaa can be any naturally occurring amino acid
  UNSURE (7)..(7): Xaa can be any naturally occurring amino acid
  VARIANT (8)..(8): / replace = "Ile" / replace = "Thr" / replace = "Leu" / replace = "Ala"
  UNSURE (9)..(18): Xaa can be any naturally occurring amino acid
  VARIANT (20)..(20): / replace = "Ser" / replace = "Pro" / replace = "Val"
  UNSURE (21)..(24): Xaa can be any naturally occurring amino acid
  VARIANT (25)..(25): / replace = "Leu"
  UNSURE (26)..(27): Xaa can be any naturally occurring amino acid
  VARIANT (28)..(28): / replace = "Asp" / replace = "Asn" / replace = "Ser"
  UNSURE (30)..(34): Xaa can be any naturally occurring amino acid
  VARIANT (35)..(35): / replace = "Tyr"
GGXXXWXVXXXXXXXXXXWAXXXXFXXGDXXXXXF

SEQ ID NO: 622 - protein, 36 aa, Artificial sequence
  motif 51
  VARIANT (1)..(1): / replace = "Val"
  VARIANT (2)..(2): / replace = "Asp" / replace = "Ala" / replace = "Glu"
  UNSURE (3)..(5): Xaa can be any naturally occurring amino acid
  misc_feature (7)..(7): Xaa can be any naturally occurring amino acid
  VARIANT (8)..(8): / replace = "Ile" / replace = "Thr" / replace = "Leu" / replace = "Ala"
  UNSURE (9)..(19): Xaa can be any naturally occurring amino acid
  VARIANT (21)..(21): / replace = "Ser" / replace = "Pro" / replace = "Val"
  UNSURE (22)..(25): Xaa can be any naturally occurring amino acid
  VARIANT (26)..(26): / replace = "Leu"
  UNSURE (27)..(28): Xaa can be any naturally occurring amino acid
  VARIANT (29)..(29): / replace = "Asp" / replace = "Asn" / replace = "Ser"
  UNSURE (31)..(35): Xaa can be any naturally occurring amino acid
  VARIANT (36)..(36): / replace = "Tyr"
GGXXXWXVXXXXXXXXXXXWAXXXXFXXGDXXXXXF

SEQ ID NO: 623 - protein, 37 aa, Artificial sequence
  motif 52
  VARIANT (1)..(1): / replace = "Val"
  VARIANT (2)..(2): / replace = "Asp" / replace = "Ala" / replace = "Glu"
  UNSURE (3)..(5): Xaa can be any naturally occurring amino acid
  misc_feature (7)..(7): Xaa can be any naturally occurring amino acid
  VARIANT (8)..(8): / replace = "Ile" / replace = "Thr" / replace = "Leu" / replace = "Ala"
  UNSURE (9)..(20): Xaa can be any naturally occurring amino acid
  VARIANT (22)..(22): / replace = "Ser" / replace = "Pro" / replace = "Val"
  UNSURE (23)..(26): Xaa can be any naturally occurring amino acid
  VARIANT (27)..(27): / replace = "Leu"
  UNSURE (28)..(29): Xaa can be any naturally occurring amino acid
  VARIANT (30)..(30): / replace = "Asp" / replace = "Asn" / replace = "Ser"
  UNSURE (32)..(36): Xaa can be any naturally occurring amino acid
  VARIANT (37)..(37): / replace = "Tyr"
GGXXXWXVXXXXXXXXXXXXWAXXXXFXXGDXXXXXF

SEQ ID NO: 624 - protein, 32 aa, Artificial sequence
  motif 53
  VARIANT (1)..(1): / replace = "Val"
  VARIANT (2)..(2): / replace = "Asp" / replace = "Ala" / replace = "Glu"
  UNSURE (3)..(6): Xaa can be any naturally occurring amino acid
  UNSURE (8)..(8): Xaa can be any naturally occurring amino acid
  VARIANT (9)..(9): / replace = "Ile" / replace = "Thr" / replace = "Leu" / replace = "Ala"
  UNSURE (10)..(15): Xaa can be any naturally occurring amino acid
  VARIANT (17)..(17): / replace = "Ser" / replace = "Pro" / replace = "Val"
  UNSURE (18)..(21): Xaa can be any naturally occurring amino acid
  VARIANT (22)..(22): / replace = "Leu"
  UNSURE (23)..(24): Xaa can be any naturally occurring amino acid
  VARIANT (25)..(25): / replace = "Asp" / replace = "Asn" / replace = "Ser"
  UNSURE (27)..(31): Xaa can be any naturally occurring amino acid
  VARIANT (32)..(32): / replace = "Tyr"
GGXXXXWXVXXXXXXWAXXXXFXXGDXXXXXF

SEQ ID NO: 625 - protein, 33 aa, Artificial sequence
  motif 54
  VARIANT (1)..(1): / replace = "Val"
  VARIANT (2)..(2): / replace = "Asp" / replace = "Ala" / replace = "Glu"
  UNSURE (3)..(6): Xaa can be any naturally occurring amino acid
  UNSURE (8)..(8): Xaa can be any naturally occurring amino acid
  VARIANT (9)..(9): / replace = "Ile" / replace = "Thr" / replace = "Leu"' / replace = "Ala"
  UNSURE (10)..(16): Xaa can be any naturally occurring amino acid
  VARIANT (18)..(18): / replace = "Ser" / replace = "Pro" / replace = "Val"
  UNSURE (19)..(22): Xaa can be any naturally occurring amino acid
  VARIANT (23)..(23): / replace = "Leu"
  UNSURE (24)..(25): Xaa can be any naturally occurring amino acid
  VARIANT (26)..(26): / replace = "Asp" / replace = "Asn" / replace = "Ser"
  UNSURE (28)..(32): Xaa can be any naturally occurring amino acid
  VARIANT (33)..(33): / replace = "Tyr"
GGXXXXWXVXXXXXXXWAXXXXFXXGDXXXXXF

SEQ ID NO: 626 - protein, 34 aa, Artificial sequence
  motif 55
  VARIANT (1)..(1): / replace = "Val"
  VARIANT (2)..(2): / replace = "Asp" / replace = "Ala" / replace = "Glu"
  UNSURE (3)..(6): Xaa can be any naturally occurring amino acid
  UNSURE (8)..(8): Xaa can be any naturally occurring amino acid
  VARIANT (9)..(9): / replace = "Ile" / replace = "Thr" / replace = "Leu" / replace = "Ala"
  UNSURE (10)..(17): Xaa can be any naturally occurring amino acid
  VARIANT (19)..(19): / replace = "Ser" / replace = "Pro" / replace = "Val"
  UNSURE (20)..(23): Xaa can be any naturally occurring amino acid
  VARIANT (24)..(24): / replace = "Leu"
  UNSURE (25)..(26): Xaa can be any naturally occurring amino acid
  VARIANT (27)..(27): / replace = "Asp" / replace = "Asn" / replace = "Ser"
  UNSURE (29)..(33): Xaa can be any naturally occurring amino acid
  VARIANT (34)..(34): / replace = "Tyr"
GGXXXXWXVXXXXXXXXWAXXXXFXXGDXXXXXF

SEQ ID NO: 627 - protein, 35 aa, Artificial sequence
  motif 56
  VARIANT (1)..(1): / replace = "Val"
  VARIANT (2)..(2): / replace = "Asp" / replace = "Ala" / replace = "Glu"
  UNSURE (3)..(6): Xaa can be any naturally occurring amino acid
  UNSURE (8)..(8): Xaa can be any naturally occurring amino acid
  VARIANT (9)..(9): / replace = "Ile" / replace = "Thr" / replace = "Leu" / replace = "Ala"
  UNSURE (10)..(18): Xaa can be any naturally occurring amino acid
  VARIANT (20)..(20): / replace = "Ser" / replace = "Pro" / replace = "Val"
  UNSURE (21)..(24): Xaa can be any naturally occurring amino acid
  VARIANT (25)..(25): / replace = "Leu"
  UNSURE (26)..(27): Xaa can be any naturally occurring amino acid
  VARIANT (28)..(28): / replace = "Asp" / replace = "Asn" / replace = "Ser"
  UNSURE (30)..(34): Xaa can be any naturally occurring amino acid
  VARIANT (35)..(35): / replace = "Tyr"
GGXXXXWXVXXXXXXXXXWAXXXXFXXGDXXXXXF

SEQ ID NO: 628 - protein, 36 aa, Artificial sequence
  motif 57
  VARIANT (1)..(1): / replace = "Val"
  VARIANT (2)..(2): / replace = "Asp" / replace = "Ala" / replace = "Glu"
  UNSURE (3)..(6): Xaa can be any naturally occurring amino acid
  UNSURE (8)..(8): Xaa can be any naturally occurring amino acid
  VARIANT (9)..(9): / replace = "Ile" / replace = "Thr" / replace = "Leu" / replace = "Ala"
  UNSURE (10)..(19): Xaa can be any naturally occurring amino acid
  VARIANT (21)..(21): / replace = "Ser" / replace = "Pro" / replace = "Val"
  UNSURE (22)..(25): Xaa can be any naturally occurring amino acid
  VARIANT (26)..(26): / replace = "Leu"
  UNSURE (27)..(28): Xaa can be any naturally occurring amino acid
  VARIANT (29)..(29): / replace = "Asp" / replace = "Asn" / replace = "Ser"
  UNSURE (31)..(35): Xaa can be any naturally occurring amino acid
  VARIANT (36)..(36): / replace = "Tyr"
GGXXXXWXVXXXXXXXXXXWAXXXXFXXGDXXXXXF

SEQ ID NO: 629 - protein, 37 aa, Artificial sequence
  motif 58
  VARIANT (1)..(1): / replace = "Val"
  VARIANT (2)..(2): / replace = "Asp" / replace = "Ala" / replace = "Glu"
  UNSURE (3)..(6): Xaa can be any naturally occurring amino acid
  UNSURE (8)..(8): Xaa can be any naturally occurring amino acid
  VARIANT (9)..(9): / replace = "Ile" / replace = "Thr" / replace = "Leu" / replace = "Ala"
  UNSURE (10)..(20): Xaa can be any naturally occurring amino acid
  VARIANT (22)..(22): / replace = "Ser" / replace = "Pro" / replace = "Val"
  UNSURE (23)..(26): Xaa can be any naturally occurring amino acid
  VARIANT (27)..(27): / replace = "Leu"
  UNSURE (28)..(29): Xaa can be any naturally occurring amino acid
  VARIANT (30)..(30): / replace = "Asp" / replace = "Asn" / replace = "Ser"
  UNSURE (32)..(36): Xaa can be any naturally occurring amino acid
  VARIANT (37)..(37): / replace = "Tyr"
GGXXXXWXVXXXXXXXXXXXWAXXXXFXXGDXXXXXF

SEQ ID NO: 630 - protein, 38 aa, Artificial sequence
  motif 59
  VARIANT (1)..(1): / replace = "Val"
  VARIANT (2)..(2): / replace = "Asp" / replace = "Ala" / replace = "Glu"
  UNSURE (3)..(6): Xaa can any naturally occurring amino acid
  UNSURE (8)..(8): Xaa can any naturally occurring amino acid
  VARIANT (9)..(9): / replace = "Ile" / replace = "Thr" / replace = "Leu" / replace = " Ala"
  UNSURE (10)..(21): Xaa can any naturally occurring amino acid
  VARIANT (23)..(23): / replace = "Ser" / replace = "Pro" / replace = "Val"
  UNSURE (24)..(27): Xaa can any naturally occurring amino acid
  VARIANT (28)..(28): / replace = "Leu"
  UNSURE (29)..(30): Xaa can any naturally occurring amino acid
  VARIANT (31)..(31): / replace = "Asp" / replace = "Asn" / replace = "Ser"
  UNSURE (33)..(37): Xaa can any naturally occurring amino acid
  VARIANT (38)..(38): / replace = "Tyr"
GGXXXXWXVXXXXXXXXXXXXWAXXXXFXXGDXXXXXF

SEQ ID NO: 631 - protein, 11 aa, Artificial sequence
  motif 60
  VARIANT (1)..(1): / replace = "His" / replace = "Tyr"
  VARIANT (2)..(2): / replace = "Phe"
  VARIANT (3)..(3): / replace = "Tyr"
  VARIANT (4)..(4): / replace = "Ala" / replace = "Ile"
  VARIANT (6)..(6): / replace = "Ala" / replace = "Asp"
  UNSURE (7)..(8): Xaa can be any naturally occurring amino acid
  VARIANT (9)..(9): / replace = "Asp"
  VARIANT (10)..(10): / replace = "Arg" / replace = "Asn"
FYFTSGXXGHC

SEQ ID NO: 632 - protein, 25 aa, Artificial sequence
  motif 61
  VARIANT (1)..(1): / replace = "Asn" / replace = "Thr"
  VARIANT (2)..(2): / replace = "Asp" / replace = "Glu"
  VARIANT (3)..(3): / replace = "Asp" / replace = "Lys" / replace = "His"
  VARIANT (4)..(4): / replace = "Ser"
  VARIANT (5)..(5): / replace = "Val" / replace = "Lys" / replace = "Met"
  VARIANT (6)..(6): / replace = "Val" / replace = "Tyr" / replace = "Ile"
  UNSURE (7)..(7): Xaa can be any naturally occurring amino acid
  VARIANT (8)..(8): / replace = "Ile" / replace = "Phe"
  UNSURE (9)..(11): Xaa can be any naturally occurring amino acid
  UNSURE (13)..(13): Xaa can be any naturally occurring amino acid
  VARIANT (14)..(14): / replace = "Tyr" / replace = "His" / replace = "Val"
  VARIANT (15)..(15): / replace = "Phe"
  VARIANT (16)..(16): / replace = "Tyr" / replace = "Ile"
  VARIANT (17)..(17): / replace = "Thr" / replace = "VCal" / replace = "Ala"
  VARIANT (19)..(19): / replace = "Ala" / replace = "Asp"
  UNSURE (20)..(24): Xaa can be any naturally occurring amino acid
DGNTLFXLXXXGXFYFISGXXXXXC

SEQ ID NO: 633 - protein, 26 aa, Artificial sequence
  motif 62
  VARIANT (1)..(1): / replace = "Asn" / replace = "Thr"
  VARIANT (2)..(2): / replace = "Asp" / replace = "Glu"
  VARIANT (3)..(3): / replace = "Asp" / replace = "Lys" / replace = "His"
  VARIANT (4)..(4): / replace = "Ser"
  VARIANT (5)..(5): / replace = "Val" / replace = "Lys" / replace = "Met"
  VARIANT (6)..(6): / replace = "Val" / replace = "Tyr" / replace = "Ile"
  UNSURE (7)..(7): Xaa can be any naturally occurring amino acid
  VARIANT (8)..(8): / replace = "Ile" / replace = "Phe"
  UNSURE (9)..(11): Xaa can be any naturally occurring amino acid
  UNSURE (13)..(13): Xaa can be any naturally occurring amino acid
  VARIANT (14)..(14): / replace = "Tyr" / replace = "His" / replace = "Val"
  VARIANT (15)..(15): / replace = "Phe"
  VARIANT (16)..(16): / replace = "Tyr" / replace = "Ile"
  VARIANT (17)..(17): / replace = "Thr" / replace = "Val" / replace = "Ala"
  VARIANT (19)..(19): / replace = "Ala" / replace = "Asp"
  UNSURE (20)..(25): Xaa can be any naturally occurring amino acid
DGNTLFXLXXXGXFYFISGXXXXXXC

SEQ ID NO: 634 - protein, 19 aa, Artificial sequence
  motif 64
  VARIANT (1)..(1): / replace = "Ser" / replace = "Asp" / replace = "Thr"
  UNSURE (2)..(2): Xaa can be any naturally occurring amino acid
  VARIANT (4)..(4): / replace = "Ser" / replace = "Pro" / replace = "Val"
  UNSURE (5)..(7): Xaa can be any naturally occurring amino acid
  VARIANT (8)..(8): / replace = "Ser" / replace = "Asn" / replace = "Thr"
  VARIANT (9)..(9): / replace = "Leu" / replace = "Val"
  UNSURE (10)..(10): Xaa can be any naturally occurring amino acid
  VARIANT (11)..(11): / replace = "Ile" / replace = "Leu" / replace = "Thr"
  VARIANT (12)..(12): / replace = "Asn"
  UNSURE (14)..(14): Xaa can be any naturally occurring amino acid
  VARIANT (15)..(15): / replace = "Ile" / replace = "Val"
  UNSURE (16)..(16): Xaa can be any naturally occurring amino acid
  VARIANT (17)..(17): / replace = "Leu" / replace = "Trp"
  UNSURE (18)..(18): Xaa can be any naturally occurring amino acid
  VARIANT (19)..(19): / replace = "Phe"
NXWAXXXRFXVGDXLXFXY

SEQ ID NO: 635 - protein, 18 aa, Artificial sequence
  motif 65
  VARIANT (2)..(2): / replace = "Ala" / replace = "Leu" / replace = "Met"
  VARIANT (3)..(3): / replace = "Ile" / replace = "Met"
  UNSURE (4)..(4): Xaa can be any natrally occurring amino acid
  VARIANT (5)..(5): / replace = "Leu"
  UNSURE (6)..(9): Xaa can be any natrally occurring amino acid
  VARIANT (10)..(10): / replace = "Phe"
  UNSURE (11)..(12): Xaa can be any natrally occurring amino acid
  VARIANT (14)..(14): / replace = "Thr" / replace = "Lys" / replace = "Asp"
  VARIANT (15)..(15): / replace = "Lys" / replace = "Thr" / replace = "Asp" / replace = "Gly"
  UNSURE (16)..(17): Xaa can be any natrally occurring amino acid
  VARIANT (18)..(18): / replace = "Ala" / replace = "His" / replace = "Tyr"
SVLXVXXXXYXXCNSXXP

SEQ ID NO: 636 - protein, 33 aa, Artificial sequence
  motif 66
  VARIANT (3)..(3): / replace = "Ala" / replace = "Leu" / replace = "Met"
  VARIANT (4)..(4): / replace = "Val" / replace = "Ile" / replace = "Met"
  VARIANT (5)..(5): / replace = "Val" / replace = "Glu"
  VARIANT (6)..(6): / replace = "Leu"
  VARIANT (7)..(7): / replace = "Thr" / replace = "Ala"
  UNSURE (8)..(10): Xaa can be any naturally occurring amino acid
  VARIANT (11)..(11): / replace = "Tyr"
  UNSURE (12)..(13): Xaa can be any naturally occurring amino acid
  VARIANT (15)..(15): / replace = "Asp" / replace = "Gln"
  UNSURE (16)..(16): Xaa can be any naturally occurring amino acid
  VARIANT (17)..(17): / replace = "Ser" / replace = "Thr"
  UNSURE (18)..(18): Xaa can be any naturally occurring amino acid
  VARIANT (20)..(20): / replace = "Val" / replace = "Ile" / replace = "Gln" / replace = "His"
  VARIANT (21)..(21): / replace = "Ala" / replace = "Thr" / replace = "Phe"
  VARIANT (22)..(22): / replace = "Phe" / replace = "Thr" / replace = "Lys" / replace = "Ser"
  VARIANT (23)..(23): / replace = "Ser" / replace = "Leu" / replace = "Met"
  UNSURE (24)..(24): Xaa can be any naturally occurring amino acid
  VARIANT (25)..(25): / replace = "Asp"
  VARIANT (26)..(26): / replace = "Glu"
  VARIANT (27)..(27): / replace = "Asp" / replace = "Lys"
  VARIANT (28)..(28): / replace = "Thr"
  UNSURE (29)..(29): Xaa can be any naturally occurring amino acid
  VARIANT (30)..(30): / replace = "Tyr" / replace = "Ile"
  misc_feature (31)..(31): Xaa can be any naturally occurring amino acid
  VARIANT (32)..(32): / replace = "Ile" / replace = "Phe"
  VARIANT (33)..(33): / replace = "Asp" / replace = "Ser" / replace = "Glu"
DSVLQVSXXXFXXCNXKXPLLYFXNGNSXFXLT

SEQ ID NO: 637 - protein, 20 aa, Artificial sequence
  motif 67
  VARIANT (1)..(1): / replace = "Phe"
  UNSURE (2)..(3): Xaa can be any naturally occurring amino acid
  VARIANT (5)..(5): / replace = "Pro" / replace = "Val"
  VARIANT (6)..(6): / replace = "Ser" / replace = "Gly"
  UNSURE (7)..(9): Xaa can be any naturally occurring amino acid
  VARIANT (10)..(10): / replace = "Leu" / replace = "Val"
  VARIANT (11)..(11): / replace = "Ala" / replace = "Arg" / replace = "Thr"
  VARIANT (12)..(12): / replace = "Ile" / replace = "Val"
  VARIANT (13)..(13): / replace = "Asn"
  VARIANT (15)..(15): / replace = "Ala" / replace = "Thr"
  VARIANT (16)..(16): / replace = "Ile"
  UNSURE (17)..(17): Xaa can be any naturally occurring amino acid
  UNSURE (19)..(19): Xaa can be any naturally occurring amino acid
YXXWAKXXXFKLGDSLXFXY

SEQ ID NO: 638 - protein, 12 aa, Artificial sequence
  motif 68
  VARIANT (1)..(1): / replace = "Phe"
  UNSURE (2)..(2): Xaa can be any naturally occurring amino acid
  VARIANT (3)..(3): / replace = "Ala"
  VARIANT (5)..(5): / replace = "Ala" / replace = "Gly" / replace = "Glu"
  UNSURE (6)..(7): Xaa can be any naturally occurring amino acid
  VARIANT (8)..(8): / replace = "Ala" / replace = "Ser"
  UNSURE (10)..(10): Xaa can be any naturally occurring amino acid
  VARIANT (11)..(11): / replace = "Ala" / replace = "Ile"
YXVGDXXGWXVP

SEQ ID NO: 639 - protein, 26 aa, Artificial sequence
  motif 69
  VARIANT (1)..(1): / replace = "Leu" / replace = "Val"
  UNSURE (2)..(2): Xaa can be any naturally occurring amino acid
  VARIANT (3)..(3): / replace = "Ile" / replace = "Val"
  VARIANT (6)..(6): / replace = "Ala"
  VARIANT (7)..(7): / replace = "Ile" / replace = "Val"
  VARIANT (8)..(8): / replace = "Phe" / replace = "Trp"
  VARIANT (12)..(12): / replace = "Leu"
  VARIANT (15)..(15): / replace = "Glu"
  VARIANT (18)..(18): / replace = "Met" / replace = "Ala" / replace = "Val"
  VARIANT (19)..(19): / replace = "Ile" / replace = "Val"
  VARIANT (21)..(21): / replace = "Leu"
  VARIANT (22)..(22): / replace = "Ala"
  UNSURE (23)..(24): Xaa can be any naturally occurring amino acid
  VARIANT (25)..(25): / replace = "Ser" / replace = "Asn"
  VARIANT (26)..(26): / replace = "Tyr"
FXLGDSLLFLYPPSQDSLLQVTXXAF

SEQ ID NO: 640 - protein, 19 aa, Artificial sequence
  motif 70
  VARIANT (2)..(2): / replace = "Asp" / replace = "Gln"
  UNSURE (3)..(3): Xaa can be any naturally occurring amino acid
  VARIANT (4)..(4): / replace = "Lys" / replace = "Thr"
  VARIANT (5)..(5): / replace = "Asn" / replace = "Ser"
  VARIANT (7)..(7): / replace = "Val" / replace = "Ile"
  VARIANT (8)..(8): / replace = "Ala" / replace = "Thr"
  UNSURE (9)..(9): Xaa can be any naturally occurring amino acid
  VARIANT (10)..(10): / replace = "Phe" / replace = "Leu"
  UNSURE (11)..(11): Xaa can be any naturally occurring amino acid
  VARIANT (12)..(12): / replace = "Asp"
  VARIANT (15)..(15): / replace = "Thr"
  VARIANT (16)..(16): / replace = "Ala" / replace = "Val"
  VARIANT (17)..(17): / replace = "Lys"
  VARIANT (18)..(18): / replace = "Phe" / replace = "Ile"
  VARIANT (19)..(19): / replace = "Thr"
CNXSDPLLXMXNGNSLNLS

SEQ ID NO: 641 - protein, 20 aa, Artificial sequence
  motif 71
  UNSURE (2)..(3): Xaa can be any naturally occurring amino acid
  VARIANT (4)..(4): / replace = "His" / replace = "Tyr"
  VARIANT (5)..(5): / replace = "Phe"
  VARIANT (6)..(6): / replace = "Tyr"
  VARIANT (7)..(7): / replace = "Ala" / replace = "Ile"
  VARIANT (9)..(9): / replace = "Ala" / replace = "Asp"
  UNSURE (10)..(11): Xaa can be any naturally occurring amino acid
  VARIANT (13)..(13): / replace = "Arg"
  UNSURE (15)..(15): Xaa can be any naturally occurring amino acid
  VARIANT (16)..(16): / replace = "Arg"
  UNSURE (17)..(17): Xaa can be any naturally occurring amino acid
  VARIANT (18)..(18): / replace = "Ser"
  VARIANT (19)..(19): / replace = "Arg"
  VARIANT (20)..(20): / replace = "Ala" / replace = "Ile"
GXXFYFTSGXXGHCXKXQKL

SEQ ID NO: 642 - protein, 13 aa, Artificial sequence
  motif 72
  VARIANT (1)..(1): / replace = "Phe"
  VARIANT (2)..(2): / replace = "Gln"
  VARIANT (5)..(5): / replace = "Ala" / replace = "Gly" / replace = "Asn"
  VARIANT (7)..(7): / replace = "Gln" / replace = "Asn"
  VARIANT (8)..(8): / replace = "Ser"
  VARIANT (10)..(10): / replace = "Ala" / replace = "Asn"
  VARIANT (11)..(11): / replace = "Ala" / replace = "Ile"
  VARIANT (13)..(13): / replace = "Ile" / replace = "Pro" / replace = "Ser"
YKVGDLDAWGVPT

SEQ ID NO: 643 - protein, 12 aa, Artificial sequence
  motif 73
  VARIANT (3)..(3): / replace = "Ala"
  VARIANT (4)..(4): / replace = "Ile" / replace = "Val"
  VARIANT (5)..(5): / replace = "Phe" / replace = "Trp"
  VARIANT (9)..(9): / replace = "Leu"
  VARIANT (12)..(12): / replace = "Glu"
GDSLLFLYPPSQ

SEQ ID NO: 644 - protein, 6 aa, Artificial sequence
  motif 74
  VARIANT (3)..(3): / replace = "Leu"
  VARIANT (6)..(6): / replace = "Glu"
LYPPSQ

SEQ ID NO: 645 - protein, 34 aa, Artificial sequence
  consensus sequence
  misc_feature (2)..(3): Xaa can be any naturally occurring amino acid
  misc_feature (5)..(15): Xaa can be any naturally occurring amino acid
  misc_feature (17)..(18): Xaa can be any naturally occurring amino acid
  misc_feature (20)..(23): Xaa can be any naturally occurring amino acid
  misc_feature (25)..(26): Xaa can be any naturally occurring amino acid
  misc_feature (28)..(30): Xaa can be any naturally occurring amino acid
  misc_feature (32)..(33): Xaa can be any naturally occurring amino acid
CXXHXXXXXXXXXXXCXXCXXXXCXXCXXXHXXH

SEQ ID NO: 646 - protein, 35 aa, Artificial sequence
  consensus sequence
  misc_feature (2)..(3): Xaa can be any naturally occurring amino acid
  misc_feature (5)..(15): Xaa can be any naturally occurring amino acid
  misc_feature (17)..(18): Xaa can be any naturally occurring amino acid
  misc_feature (20)..(23): Xaa can be any naturally occurring amino acid
  misc_feature (25)..(26): Xaa can be any naturally occurring amino acid
  misc_feature (28)..(31): Xaa can be any naturally occurring amino acid
  misc_feature (33)..(34): Xaa can be any naturally occurring amino acid
CXXHXXXXXXXXXXXCXXCXXXXCXXCXXXXHXXH

SEQ ID NO: 647 - protein, 36 aa, Artificial sequence
  consensus sequence
  misc_feature (2)..(3): Xaa can be any naturally occurring amino acid
  misc_feature (5)..(15): Xaa can be any naturally occurring amino acid
  misc_feature (17)..(18): Xaa can be any naturally occurring amino acid
  misc_feature (20)..(23): Xaa can be any naturally occurring amino acid
  misc_feature (25)..(26): Xaa can be any naturally occurring amino acid
  misc_feature (28)..(32): Xaa can be any naturally occurring amino acid
  misc_feature (34)..(35): Xaa can be any naturally occurring amino acid
CXXHXXXXXXXXXXXCXXCXXXXCXXCXXXXXHXXH

SEQ ID NO: 648 - protein, 37 aa, Artificial sequence
  consensus sequence
  misc_feature (2)..(3): Xaa can be any naturally occurring amino acid
  misc_feature (5)..(15): Xaa can be any naturally occurring amino acid
  misc_feature (17)..(18): Xaa can be any naturally occurring amino acid
  misc_feature (20)..(23): Xaa can be any naturally occurring amino acid
  misc_feature (25)..(26): Xaa can be any naturally occurring amino acid
  misc_feature (28)..(33): Xaa can be any naturally occurring amino acid
  misc_feature (35)..(36): Xaa can be any naturally occurring amino acid
CXXHXXXXXXXXXXXCXXCXXXXCXXCXXXXXXHXXH

SEQ ID NO: 649 - protein, 38 aa, Artificial sequence
  consensus sequence
  misc_feature (2)..(3): Xaa can be any naturally occurring amino acid
  misc_feature (5)..(15): Xaa can be any naturally occurring amino acid
  misc_feature (17)..(18): Xaa can be any naturally occurring amino acid
  misc_feature (20)..(23): Xaa can be any naturally occurring amino acid
  misc_feature (25)..(26): Xaa can be any naturally occurring amino acid
  misc_feature (28)..(34): Xaa can be any naturally occurring amino acid
  misc_feature (36)..(37): Xaa can be any naturally occurring amino acid
CXXHXXXXXXXXXXXCXXCXXXXCXXCXXXXXXXHXXH

SEQ ID NO: 650 - protein, 35 aa, Artificial sequence
  consensus sequence
  misc_feature (2)..(3): Xaa can be any naturally occurring amino acid
  misc_feature (5)..(15): Xaa can be any naturally occurring amino acid
  misc_feature (17)..(18): Xaa can be any naturally occurring amino acid
  misc_feature (20)..(24): Xaa can be any naturally occurring amino acid
  misc_feature (26)..(27): Xaa can be any naturally occurring amino acid
  misc_feature (29)..(31): Xaa can be any naturally occurring amino acid
  misc_feature (33)..(34): Xaa can be any naturally occurring amino acid
CXXHXXXXXXXXXXXCXXCXXXXXCXXCXXXHXXH

SEQ ID NO: 651 - protein, 36 aa, Artificial sequence
  consensus sequence
  misc_feature (2)..(3): Xaa can be any naturally occurring amino acid
  misc_feature (5)..(15): Xaa can be any naturally occurring amino acid
  misc_feature (17)..(18): Xaa can be any naturally occurring amino acid
  misc_feature (20)..(24): Xaa can be any naturally occurring amino acid
  misc_feature (26)..(27): Xaa can be any naturally occurring amino acid
  misc_feature (29)..(32): Xaa can be any naturally occurring amino acid
  misc_feature (34)..(35): Xaa can be any naturally occurring amino acid
CXXHXXXXXXXXXXXCXXCXXXXXCXXCXXXXHXXH

SEQ ID NO: 652 - protein, 37 aa, Artificial sequence
  consensus sequence
  misc_feature (2)..(3): Xaa can be any naturally occurring amino acid
  misc_feature (5)..(15): Xaa can be any naturally occurring amino acid
  misc_feature (17)..(18): Xaa can be any naturally occurring amino acid
  misc_feature (20)..(24): Xaa can be any naturally occurring amino acid
  misc_feature (26)..(27): Xaa can be any naturally occurring amino acid
  misc_feature (29)..(33): Xaa can be any naturally occurring amino acid
  misc_feature (35)..(36): Xaa can be any naturally occurring amino acid
CXXHXXXXXXXXXXXCXXCXXXXXCXXCXXXXXHXXH

SEQ ID NO: 653 - protein, 38 aa, Artificial sequence
  consensus sequence
  misc_feature (2)..(3): Xaa can be any naturally occurring amino acid
  misc_feature (5)..(15): Xaa can be any naturally occurring amino acid
  misc_feature (17)..(18): Xaa can be any naturally occurring amino acid
  misc_feature (20)..(24): Xaa can be any naturally occurring amino acid
  misc_feature (26)..(27): Xaa can be any naturally occurring amino acid
  misc_feature (29)..(34): Xaa can be any naturally occurring amino acid
  misc_feature (36)..(37): Xaa can be any naturally occurring amino acid
CXXHXXXXXXXXXXXCXXCXXXXXCXXCXXXXXXHXXH

SEQ ID NO: 654 - protein, 39 aa, Artificial sequence; identical to SEQ ID NO: 262
  consensus sequence
  misc_feature (2)..(3): Xaa can be any naturally occurring amino acid
  misc_feature (5)..(15): Xaa can be any naturally occurring amino acid
  misc_feature (17)..(18): Xaa can be any naturally occurring amino acid
  misc_feature (20)..(24): Xaa can be any naturally occurring amino acid
  misc_feature (26)..(27): Xaa can be any naturally occurring amino acid
  misc_feature (29)..(35): Xaa can be any naturally occurring amino acid
  misc_feature (37)..(38): Xaa can be any naturally occurring amino acid

SEQ ID NO: 655 - protein, 19 aa, Artificial sequence
  consensus sequence
  misc_feature (2)..(3): Xaa can be any naturally occurring amino acid
  misc_feature (5)..(14): Xaa can be any naturally occurring amino acid
  misc_feature (16)..(18): Xaa can be any naturally occurring amino acid
CXXCXXXXXXXXXXCXXXC

SEQ ID NO: 656 - protein, 20 aa, Artificial sequence
  consensus sequence
  misc_feature (2)..(3): Xaa can be any naturally occurring amino acid
  misc_feature (5)..(15): Xaa can be any naturally occurring amino acid
  misc_feature (17)..(19): Xaa can be any naturally occurring amino acid
CXXCXXXXXXXXXXXCXXXC

SEQ ID NO: 657 - DNA, 54 bp, Artificial sequence
  primer: prm13820
ggggacaagtttgtacaaaaaagcaggcttaaacaatggcacgacacgatccta

SEQ ID NO: 658 - DNA, 50 bp, Artificial sequence
  primer: prm13821
ggggaccactttgtacaagaaagctgggttgatttcttcatagtgcacgc

SEQ ID NO: 659 - DNA, 53 bp, Artificial sequence
  primer: prm13818
ggggacaagtttgtacaaaaaagcaggcttaaacaatgaatcgccaccacgat

SEQ ID NO: 660 - DNA, 50 bp, Artificial sequence
  primer: prm13819
ggggaccactttgtacaagaaagctgggttctccttttcacttgtttccc

SEQ ID NO: 661 - DNA, 56 bp, Artificial sequence
  primer: prm13816
ggggacaagtttgtacaaaaaagcaggcttaaacaatggctaatcgttatgatcca

SEQ ID NO: 662 - DNA, 50 bp, Artificial sequence
  primer: prm13817
ggggaccactttgtacaagaaagctgggtcaaggagaactctcaaacagc

SEQ ID NO: 663 - DNA, 1080 bp, Arabidopsis thaliana
aacgctagcatggatctcgggccccaaataatgattttattttgactgatagtgacctgttcgttgcaacaaattgatgagcaatgcttttttataatgccaactttgtacaaaaaagcaggcttaaacaatgaatcgccaccacgatcccaatcctttcgatgaggacgaagaaatcgtcaatcctttttcgaaaggtggtggaagggttcctgctgcatctaggccagttgaatatggtcaaagccttgatgctactgttgatattccattggataatatgaatgactcttcacagaaacagagaaagcttgctgactgggaagctgagctcaggaagaaagaaatggatataaagcgaagagaggaagctattgctaaatttggtgtgcagatagatgataaaaactggccaccgtttttcccaatcatacaccatgacattgctaaagagataccagttcatgcacaaaagctgcagtatctggctttcgctagttggttaggtatcgttctgtgtctggtattcaatgtcattgcaacgatggtctgctggattaaaggcggaggtgttaaaatctttttcctggccacaatatatgcattgatcggatgtccactctcttatgtactatggtacaggccactctaccgagccatgaggactgacagtgctttgaagtttggttggtttttcttcacctacttgattcacattggcttctgcatcgttgctgccatcgcccctccaatctttttccatggaaaatcattaacgggtgtgcttgcagcaattgatgtcatctcagacagtttattagctgggatcttctactttatcggattcggtctcttctgcttggagtcactgctgagtctatgggttcttcagaaaatttacctctactttaggggaaacaagtgaaaaggagaacccagctttcttgtacaaagttggcattataagaaagcattgcttatcaatttgttgcaacgaacaggtcactatcagtcaaaataaaatcattatttgccatccagctgcagctctggcccgtgtctcaaaatctctgatgttac

SEQ ID NO: 664 - protein, 264 aa, Arabidopsis thaliana; identical to SEQ ID NO: 89

SEQ ID NO: 665 - DNA, 1047 bp, Arabidopsis thaliana
gactgttcgttgcacaaattgatgagcaatgcttttttataatgccaactttgtacaaaaaagcaggcttaaacaatggctaatcgttatgatccaaatcctttcgctgaggaagaagaagtcaatcctttcgctaatgctagaggagttccacctgcgtcgaattcgagactttcgcctttgcctccagagcctgttggtttcgattatggtcgaaccgtagacattcctcttgacagagctggtacacaggatttgaagaagaaagagaaggaactccaagccaaagaagctgagctaaaacgacgagagcaggacctcaaacggaaagaagatgctgctgcacgagctggaatcgttattgaagtgaaaaactggccgcctttcttcccacttatccaccatgacatcgcaaacgaaattccggttcatctccaaagactacagtatgttacctttgcaacgtatttggggttggttctttgtcttttctggaatatcatcgccgttactacagcttggatcaaaggagaaggagtgacgatatggcttcttgccttaatttacttcatagcgggtgttccaggaggctatgtgttatggtatcgaccactctaccgtgccttcagaactgatagtgcattgagctttggatggtttttcttgttctatatgctccacattgctttctgcgtctttgctgcagttgctccacctgtcgtcttcaaaggaaaatctcttgctgggatcttacctgcaatagatgtcttaagtggtcaagcaattgttgggatattctacttcattgggtttgcatttttctgcctcgaatcagtggttagcatctgggttattcagcaagtgtatatgtacttccgaggcagcgggaaacaagatcaaatgagacgggaagcagcgagaggagccttgagagccgctgtttgagagttctccttgacccagctttcttgtacaaagttggcattataagaaagcattgcttatcaatttgttgcaacgaacaggtcactatcagtcaaaataaaa

SEQ ID NO: 666 - protein, 289 aa, Arabidopsis thaliana; identical to SEQ ID NO: 97

SEQ ID NO: 667 - protein, 24 aa, Artificial sequence
  motif 63
  VARIANT (1)..(1): / replace = "Asn" / replace = "Thr"
  VARIANT (2)..(2): / replace = "Asp" / replace = "Glu"
  VARIANT (3)..(3): / replace = "Asp" / replace = "Lys" / replace = "His"
  VARIANT (4)..(4): / replace = "Ser"
  VARIANT (5)..(5): / replace = "Val" / replace = "Lys" / replace = "Met"
  VARIANT (6)..(6): / replace = "Val" / replace = "Tyr" / replace = "Ile"
  UNSURE (7)..(7): Xaa can be any naturally occurring amino acid
  VARIANT (8)..(8): / replace = "Ile" / replace = "Phe"
  UNSURE (9)..(11): Xaa can be any naturally occurring amino acid
  misc_feature (13)..(13): Xaa can be any naturally occurring amino acid
  VARIANT (14)..(14): / replace = "Tyr" / replace = "His" / replace = "Val"
  VARIANT (15)..(15): / replace = "Phe"
  VARIANT (16)..(16): / replace = "Tyr" / replace = "Ile"
  VARIANT (17)..(17): / replace = "Thr" / replace = "Val" / replace = "Ala"
  VARIANT (19)..(19): / replace = "Ala" / replace = "Asp"
  UNSURE (20)..(23): Xaa can be any naturally occurring amino acid
DGNTLFXLXXXGXFYFISGXXXXC

SEQ ID NO: 668 - protein, 32 aa, Chlamydomonas sp.
MAMAMRSTFAARVGAKPAVRGARPASRMSCMA

SEQ ID NO: 669 - protein, 32 aa, Chlamydomonas
MQVTMKSSAVSGQRVGGARVATRSVRRAQLQV

SEQ ID NO: 670 - protein, 52 aa, Arabidopsis thaliana
MASLMLSLGSTSLLPREINKDKLKLGTSASNPFLKAKSFSRVTMTVAVKPSR

SEQ ID NO: 671 - protein, 54 aa, Arabidopsis thaliana
MATQFSASVSLQTSCLATTRISFQKPALISNHGKTNLSFNLRRSIPSRRLSVSC

SEQ ID NO: 672 - protein, 70 aa, Arabidopsis thaliana
MASIAASASISLQARPRQLAIAASQVKSFSNGRRSSLSFNLRQLPTRLTVSCAAKPETVDKVCAVVRKQL

SEQ ID NO: 673 - protein, 74 aa, Arabidopsis thaliana
MASIATSASTSLQARPRQLVIGAKQVKSFSYGSRSNLSFNLRQLPTRLTVYCAAKPETVDKVCAVVRKQLSLKE

SEQ ID NO: 674 - protein, 577 aa, Oryza sativa; identical to SEQ ID NO: 579

The invention claimed is:

1. A method for increasing seed yield and/or biomass in a plant relative to a corresponding control plant, comprising introducing and expressing in a plant a nucleic acid encoding a polypeptide having at least 95% sequence identity to the amino acid sequence of SEQ ID NO: 261, and selecting for a plant having increased seed yield and/or biomass relative to a corresponding control plant.

2. The method of claim 1, wherein said polypeptide comprises one or more of the motifs of SEQ ID NO: 264, 265, 266, 267, 268, 269, 270, 271 and 272.

3. The method of claim 1, wherein said nucleic acid is:
   (i) a nucleic acid comprising the nucleotide sequence of SEQ ID NO: 260; or
   (ii) a nucleic acid encoding a polypeptide comprising the amino acid sequence of SEQ ID NO: 261.

4. The method of claim 1, wherein said increased seed yield comprises increased total seed weight, increased number of flowers per plant, increased number of seeds, increased number of filled seeds, increased seed filling rate, increased harvest index, and/or increased thousand kernel weight (TKW).

5. The method of claim 1, wherein said increased seed yield and/or biomass is obtained under non-stress conditions.

6. The method of claim 1, wherein said increased seed yield and/or biomass is obtained under conditions of drought stress, salt stress, or nitrogen deficiency.

7. A plant obtained by the method of claim 1, or a plant part, seed or progeny of said plant, wherein said plant, or said plant part, seed or progeny, comprises said nucleic acid.

8. A plant, plant part, or plant cell comprising a construct comprising:
   (i) a nucleic acid sequence encoding a polypeptide having at least 95% sequence identity to the amino acid sequence of SEQ ID NO: 261; and
   (ii) one or more heterologous control sequences capable of driving expression of the nucleic acid sequence of (i); and optionally
   (iii) a transcription termination sequence,
   wherein the plant is a crop plant selected from the group consisting of soybean, sunflower, canola, alfalfa, rapeseed, linseed, cotton, tomato, potato, tobacco and beet, a monocot, or a cereal.

9. A method for the production of a transgenic plant having increased yield, increased biomass, and/or increased seed yield relative to a corresponding control plant, comprising:
   (i) introducing and expressing in a plant a nucleic acid encoding a polypeptide having at least 95% sequence identity to the amino acid sequence of SEQ ID NO: 261; and
   (iii) selecting for a transgenic plant having increased yield, increased biomass, and/or increased seed yield relative to a corresponding control plant.

10. A transgenic plant having increased yield, increased biomass, and/or increased seed yield relative to a corresponding control plant, resulting from introducing and expressing a nucleic acid encoding a polypeptide having at least 95% sequence identity to the amino acid sequence of SEQ ID NO: 261 in said plant, wherein the plant is a crop plant selected from the group consisting of soybean, sunflower, canola, alfalfa, rapeseed, linseed, cotton, tomato, potato, tobacco and beet, a monocot, or a cereal.

11. The transgenic plant of claim 10, wherein said nucleic acid is:
   (i) a nucleic acid comprising the nucleotide sequence of SEQ ID NO: 260; or
   (ii) a nucleic acid encoding a polypeptide comprising the amino acid sequence of SEQ ID NO: 261.

12. The transgenic plant of claim 10, wherein said plant is rice, maize, wheat, barley, millet, rye, triticale, sorghum, emmer, spelt, secale, einkorn, teff, milo, or oats.

13. Harvestable parts of the transgenic plant of claim 10, wherein said harvestable parts comprises said nucleic acid.

14. Products obtained from the transgenic plant of claim 10 and/or from harvestable parts of said plant, wherein said products comprises said nucleic acid.

15. The method of claim 1, wherein said nucleic acid encodes a polypeptide having at least 98% sequence identity to the amino acid sequence of SEQ ID NO: 261.

16. The method of claim 1, wherein said nucleic acid encodes a polypeptide having at least 99% sequence identity to the amino acid sequence of SEQ ID NO: 261.

17. The transgenic plant of claim 10, wherein said nucleic acid encodes a polypeptide having at least 98% sequence identity to the amino acid sequence of SEQ ID NO: 261.

18. The transgenic plant of claim 10, wherein said nucleic acid encodes a polypeptide having at least 99% sequence identity to the amino acid sequence of SEQ ID NO: 261.

19. The method of claim 1, wherein said polypeptide comprises a first zinc binding region at the N-terminal and a second zinc binding region in the central region.

20. The method of claim 1, wherein said polypeptide comprises:
   (i) at least one or more of the motifs of SEQ ID NO: 264, 265 and 266;
   (ii) at least one or more of the motifs of SEQ ID NO: 267, 268 and 269; or
   (iii) at least one or more of the motifs of SEQ ID NO: 270, 271 and 272.

21. The transgenic plant of claim 10, wherein said polypeptide comprises a first zinc binding region at the N-terminal and a second zinc binding region in the central region.

22. The transgenic plant of claim 10, wherein said polypeptide comprises:
- (i) at least one or more of the motifs of SEQ ID NO: 264, 265 and 266;
- (ii) at least one or more of the motifs of SEQ ID NO: 267, 268 and 269; or
- (iii) at least one or more of the motifs of SEQ ID NO: 270, 271 and 272.

* * * * *